United States Patent
Gottesman et al.

(10) Patent No.: US 10,941,404 B2
(45) Date of Patent: Mar. 9, 2021

(54) TREATMENT OF ANGIOPOIETIN LIKE 7 (ANGPTL7) RELATED DISEASES

(71) Applicant: EMPIRICO INC., San Diego, CA (US)

(72) Inventors: Omri Gottesman, San Diego, CA (US); Shannon Bruse, San Diego, CA (US); Paul Buske, Madison, WI (US); Brian Cajes, San Diego, CA (US); David Lewis, Madison, WI (US); David Rozema, Cross Plains, WI (US)

(73) Assignee: EMPIRICO INC., San Diego, CA (US)

( * ) Notice: Subject to any disclaimer, the term of this patent is extended or adjusted under 35 U.S.C. 154(b) by 0 days.

(21) Appl. No.: 17/012,524

(22) Filed: Sep. 4, 2020

(65) Prior Publication Data

US 2020/0399640 A1 Dec. 24, 2020

Related U.S. Application Data

(63) Continuation of application No. PCT/US2020/034063, filed on May 21, 2020.

(60) Provisional application No. 62/852,813, filed on May 24, 2019, provisional application No. 62/881,906, filed on Aug. 1, 2019.

(51) Int. Cl.
*C12N 15/113* (2010.01)
*A61P 27/06* (2006.01)

(52) U.S. Cl.
CPC .......... *C12N 15/1136* (2013.01); *A61P 27/06* (2018.01); *C12N 2310/14* (2013.01); *C12N 2310/315* (2013.01); *C12N 2310/321* (2013.01); *C12N 2310/322* (2013.01); *C12N 2310/3515* (2013.01)

(58) Field of Classification Search
None
See application file for complete search history.

(56) References Cited

U.S. PATENT DOCUMENTS

| | | | |
|---|---|---|---|
| 7,691,997 B2 * | 4/2010 | Khvorova | A61P 35/02 536/24.5 |
| 9,796,974 B2 | 10/2017 | Rajeev et al. | |
| 9,920,320 B2 | 3/2018 | Russell et al. | |
| 10,053,694 B2 * | 8/2018 | Lee | A61P 13/00 |
| 10,668,170 B2 | 6/2020 | Rajeev et al. | |
| 2004/0198640 A1 * | 10/2004 | Leake | C12N 15/111 514/44 R |
| 2006/0148743 A1 * | 7/2006 | Jadhav | C12N 15/1137 514/44 A |
| 2008/0038202 A1 * | 2/2008 | Zhao | G01N 33/5073 424/9.2 |
| 2015/0174203 A1 | 6/2015 | Chen et al. | |
| 2018/0105563 A1 | 4/2018 | Usui et al. | |

FOREIGN PATENT DOCUMENTS

| WO | WO-2010093816 A2 | 8/2010 |
|---|---|---|
| WO | WO-2015106128 A2 | 7/2015 |
| WO | WO-2020154268 A2 | 7/2020 |

OTHER PUBLICATIONS

Battacharya et al.: Proteomics Reveal Cochlin Deposits Associated with Glaucomatous Trabecular Meshwork. J. Biol. Chem. 280(7):6080-6084 (2005).
Comes et al.: Individual molecule response to elevated intraocular pressure in perfused postmortem human eyes. Physiol. Genomics 38:205-225 (2009).
Comes et al., Evidence for a role of angiopoietin-like 7 (ANGPTL7) in extracellular matrix formation of the human trabecular meshwork: implications for glaucoma. Genes to Cells 16(2):243-259 (2011).
Kuchtey et al., Angiopoietin-like 7 secretion is induced by glaucoma stimuli and its concentration is elevated in glaucomatous aqueous humor. Investigative Ophthalmology and Visual Science 49(8):3438-3448 (2008).
PCT/US2020/034063 Invitation to Pay Additional Fees dated Aug. 21, 2020.
Rozsa et al.: Gene expression profile of human trabecular meshwork cells in response to long-term dexamethasone exposure. Molecular Vision. 125-141 (2006).
Santa Cruz Biotechnology, Inc.: Angptl7 siRNA (h): sc-88201 (1 page) https://datasheets.scbt.com/sc-88201.pdf (2019).
Toyono et al.: Angiopoietin-Like 7 Is an Anti-Angiogenic Protein Required to Prevent Vascularization of the Cornea. PLoS One. DOI: 10.1371/journal.pone.0116838 (2015).

* cited by examiner

*Primary Examiner* — Tracy Vivlemore
(74) *Attorney, Agent, or Firm* — Wilson Sonsini Goodrich & Rosati

(57) ABSTRACT

Provided herein are oligonucleotide compositions that inhibit ANGPTL7 and reduce intraocular pressure when administered to an eye. The oligonucleotide compositions contain nucleoside modifications.

20 Claims, 12 Drawing Sheets
Specification includes a Sequence Listing.

TREATMENT OF ANGIOPOIETIN LIKE 7 (ANGPTL7) RELATED DISEASES

CROSS-REFERENCE TO RELATED APPLICATIONS

This application is a continuation of International Application No. PCT/US20/34063, filed May 21, 2020, which claims the benefit of U.S. Provisional Application No. 62/852,813, filed May 24, 2019, and of U.S. Provisional Application No. 62/881,906, filed Aug. 1, 2019, which applications are incorporated herein by reference in their entireties.

SEQUENCE LISTING

The instant application contains a Sequence Listing which has been submitted electronically in ASCII format and is hereby incorporated by reference in its entirety. Said ASCII copy, created on May 15, 2020, is named 54462-709_301_SL.txt and is 3,368,652 kilobytes in size.

BACKGROUND

Large-scale human genetic data provides a mechanism for improving the success rate of pharmaceutical discovery and development by leveraging experiments of nature.

The Genome Wide Association Study (GWAS) is an experimental design to detect associations between genetic variants and traits in a population sample. The purpose is to better understand the biology of disease and to develop treatments based on this understanding. GWAS can utilize genotyping and/or sequencing data and often involves evaluation of millions of genetic variants that are relatively evenly distributed across the genome. The most common GWAS design is the case-control study, which involves comparing variant frequencies in cases versus controls. If a variant has a significantly different frequency in cases versus controls, that variant is said to be associated with disease. The commonly reported association statistics for GWAS are p-values, as a measure of statistical significance and odds ratios (OR) or beta coefficients (beta), as a measure of effect size. Researchers often assume an additive genetic model and calculate an allelic odds ratio, which is the increased (or decreased) risk of disease conferred by each additional copy of an allele (compared to carrying no copies of that allele). An additional and important concept in design and interpretation of GWAS is that of linkage disequilibrium, which is the non-random association of alleles. The presence of linkage disequilibrium can obfuscate which is the "causal" variant.

Functional annotation of variants and/or wet lab experimentation can identify the causal genetic variant identified via GWAS, and in many cases, this has led to the identification of disease-causing genes. In particular, understanding the functional effect of a causal genetic variant (e.g. loss or gain of protein function, increase or decrease in gene expression) allows that variant to be used as a proxy for therapeutic modulation of the target gene and to gain an insight into the potential therapeutic efficacy and safety of a therapeutic that modulates that target.

Identification of such gene-disease associations has provided fundamental insights into disease biology and is rapidly becoming an essential means of identifying novel therapeutic targets for the pharmaceutical industry. In order to translate the therapeutic insights derived from human genetics, disease biology in patients must be exogenously 'programmed' into replicating the observation from human genetics. Today, the potential options for therapeutic modality that could be brought to bear in translating therapeutic targets identified via human genetics into novel medicines are greater than ever before. These include well established therapeutic modalities such as small molecules and monoclonal antibodies, maturing modalities such as oligonucleotides and emerging modalities such as gene therapy and gene editing. The choice of therapeutic modality depends on several factors including the location of the target (e.g. intracellular, extracellular or secreted), the relevant tissue (e.g. lung, liver) and the relevant indication.

SUMMARY

Glaucoma is a heterogenous group of diseases, affecting greater than 70 million people worldwide, that is characterized by optic nerve damage resulting in a progressive loss of retinal ganglion cells and leading to loss of vision. The different subtypes of glaucoma are generally stratified by the iridocorneal angle, with open-angle glaucoma accounting for approximately 75% of cases. Though the pathophysiology of glaucoma remains poorly understood, a primary causal feature and risk factor is elevated intraocular pressure (IOP). IOP is determined by the balance between aqueous humor secretion from the ciliary body and its drainage through the trabecular meshwork and uveoscleral outflow pathways. Reducing IOP is the only strategy that has been proven to prevent the development or slow the progression of glaucoma and consequently, treatment is focused on lowering IOP to target levels by increasing aqueous outflow or decreasing aqueous production. Several classes of IOP-lowering medication are used, including prostaglandin analogues, beta-adrenergic blockers, alpha-adrenergic agonists, carbonic anhydrase inhibitors and most-recently rho kinase inhibitors. Surgical methods, such as laser trabeculoplasty to improve drainage of aqueous humor through the trabecular meshwork, are also employed. Despite the availability of medical and surgical therapies for glaucoma, it is the leading cause of irreversible blindness worldwide and there remains a need for novel therapeutic strategies that may further reduce the risk of the significant morbidity and reduction in quality of life associated with loss of vision.

In one aspect, provided is a composition comprising an inhibitor or modulator of ANGPTL7 that is efficacious in treating glaucoma and ocular hypertension. In some embodiments, the inhibitor or modulator of ANGPTL7 is an RNAi. In some embodiments, the RNAi is siRNA. In some embodiments, the siRNA comprises one or more sense strand and antisense strand sequences selected from SEQ ID NOS: 1-4412. In some embodiments, the siRNA comprises a sequence comprising the reverse complement of a sequence selected from SEQ ID NOS: 1-4412. In some embodiments, the siRNA comprises a sequence having at least about 85%, 90%, or 95% homology to a sequence selected from SEQ ID NOS: 1-4412. In some embodiments, the siRNA comprises a sequence having at least about 85%, 90%, or 95% identity to a sequence selected from SEQ ID NOS: 1-4412. In some embodiments, the RNAi is miRNA. In some embodiments, the RNAi is an antisense oligonucleotide (ASO). In some embodiments, the ASO is double-stranded or single-stranded. In some embodiments, the inhibitor of ANGPTL7 is a small molecule. In some embodiments, the inhibitor of ANGPTL7 is an aptamer. In some embodiments, the aptamer is an oligonucleotide aptamer. In some embodiments, the aptamer is a peptide aptamer. In some embodiments, the inhibitor of ANGPTL7 is an antibody. In some embodiments, the antibody is a monoclonal antibody.

In another aspect, provided herein are molecules for inhibition or modulation of angiopoietin-like 7 (ANGPTL7) gene products, including dsRNA (dsRNA) agents such as small interfering RNAs (siRNAs), or antisense oligonucleotides for therapeutic use. Further provided are methods of inhibiting the expression of a target gene by administering a dsRNA agent, or antisense oligonucleotide, e.g., for the treatment of various diseases involving ANGPTL7 gene products. Also provided is a method of modulating the expression of a target gene in a cell, comprising providing to said cell a dsRNA agent, or antisense oligonucleotide. In some embodiments, the target gene is ANGPTL7.

In another aspect, provided is a method of treating one or more disorders of the eye in a subject in need thereof comprising editing an ANGPTL7 gene in the subject wherein the one or more disorders of the eye comprises glaucoma or ocular hypertension. In some embodiments, the editing of the ANGPTL7 gene comprises administering CRISPR/cas9 to the subject. In some embodiments, the CRISPR/cas9 targets the ANGPTL7 gene. In some embodiments, the CRISPR/cas9 edits the ANGPTL7 gene to a loss of function mutation. In some embodiments, the loss of function mutation comprises a premature stop mutation. In some embodiments, the premature stop mutation occurs at amino acid position 177 according to the human protein sequence numbering. In some embodiments, the CRISPR/cas9 edits the ANGPTL7 gene to a missense mutation. In some embodiments, the missense mutation comprises a glutamine to histidine mutation. In some embodiments, the glutamine to histidine mutation occurs at amino acid position 175 according to the human protein sequence numbering. In some embodiments, the CRISPR/cas9 is delivered systemically to the subject. In some embodiments, the CRISPR/cas9 is delivered locally to the subject. In some embodiments, the CRISPR/cas9 is delivered locally to the eye of the subject. In some embodiments, the CRISPR/cas9 is delivered locally to the eye of the subject via intraocular injection. In some embodiments, the CRISPR/cas9 is delivered locally to the eye of the subject via topical solution. In some embodiments, the editing of the ANGPTL7 gene is efficacious in treating the one or more disorders of the eye. In some embodiments, the one or more disorders of the eye is glaucoma. In some embodiments, the subject has ocular hypertension. In some embodiments, the subject has received a first line treatment comprising topical ocular prostaglandin analogues, beta-adrenergic blockers, alpha-adrenergic agonists, and carbonic anhydrase inhibitors for the one or more disorders of the upper and eye. In some embodiments, the editing of the ANGPTL7 gene causes a reduction in or modulation of the production of the gene product of ANGPTL7. In some embodiments, the editing of the ANGPTL7 gene causes a reduction in the subject of intraocular pressure.

In another aspect, provided is a composition comprising CRISPR/cas9 that targets ANGPTL7 that is efficacious in treating glaucoma or ocular hypertension. In some embodiments, the CRISPR/cas9 edits the ANGPTL7 gene to a loss of function mutation. In some embodiments, the loss of function mutation comprises a premature stop mutation. In some embodiments, the premature stop mutation occurs at amino acid position 177 according to the human protein sequence numbering. In some embodiments, the CRISPR/cas9 edits the ANGPTL7 gene to a missense mutation. In some embodiments, the missense mutation comprises a glutamine to histidine mutation. In some embodiments, the glutamine to histidine mutation occurs at amino acid position 175 according to the human protein sequence numbering.

A non-limiting example of a therapeutic molecule for inhibiting or modulating ANGPTL7 is RNA interference (RNAi), where double-stranded RNAi (dsRNA) can be utilized to block gene expression. Short dsRNA directs gene-specific, post-transcriptional silencing in many organisms, including vertebrates, and has provided a new tool for studying gene function. RNAi is mediated by RNA-induced silencing complex (RISC), a sequence-specific, multi-component nuclease that destroys messenger RNAs homologous to the silencing trigger. RISC is known to contain short RNAs (approximately 21 nucleotides) derived from the double-stranded RNA trigger, but the protein components of this activity remained unknown.

Another non-limiting example of a therapeutic molecule for inhibiting or modulating ANGPTL7 is antisense oligonucleotides. DNA-RNA and RNA-RNA hybridization are important to many aspects of nucleic acid function including DNA replication, transcription, and translation. Hybridization is also central to a variety of technologies that either detect a particular nucleic acid or alter its expression. Antisense nucleotides, for example, disrupt gene expression by hybridizing to target RNA, thereby interfering with RNA splicing, transcription, translation, and replication. Antisense DNA has the added feature that DNA-RNA hybrids serve as a substrate for digestion by ribonuclease H (RNaseH), an activity that is present in most cell types. Antisense molecules can be delivered into cells, as is the case for oligodeoxynucleotides (ODNs), or they can be expressed from endogenous genes as RNA molecules.

Another non-limiting example of a therapeutic molecule for inhibiting or modulating ANGPTL7 is splice switching antisense oligonucleotides (SSOs). These are short, synthetic, antisense, modified nucleic acids that hybridize with a pre-mRNA and disrupt the normal splicing repertoire of the transcript by blocking the RNA-RNA base-pairing or protein-RNA binding interactions that occur between components of the splicing machinery and the pre-mRNA. Splicing of pre-mRNA is required for the proper expression of the vast majority of protein-coding genes, and thus, targeting the process offers a means to manipulate protein production from a gene. As an example, the splicing of a pre-mRNA can also be used to alter the reading frame downstream of the splice site leading to a truncated protein with impaired function.

Splice switching antisense oligonucleotides differ from mRNA cleaving antisense oligonucleotides in that they do not recruit RNaseH to degrade the pre-mRNA SSO complex and are strictly steric blocking. This is accomplished through the use of fully, or nearly fully, 2'-modified antisense oligonucleotides that therefore lack the necessary DNA-RNA hybrid region that is recognized by RNaseH. Other types of modified oligonucleotides for modifying splicing are phosphoramidite morpholinos (PMOs). PMOs have a morpholine ring in place of the furanose ring found in natural nucleic acids and a neutral phosphorodiamidate backbone in place of the negatively charged phosphodiester backbone.

In some embodiments, the present disclosure provides methods for inhibiting or modulating the action of a natural transcript by using antisense oligonucleotide(s) targeted to any region of the natural transcript. It is also contemplated herein that inhibition or modulation of the natural transcript can be achieved by siRNA, ribozymes and small molecules. In an exemplary embodiment, the natural transcript encodes for ANGPTL7.

One embodiment provides a method of modulating function and/or expression of an ANGPTL7 polynucleotide in patient cells or tissues, in vivo or in vitro, the method comprising contacting said cells or tissues with an antisense oligonucleotide 5 to 30 nucleotides in length, wherein said antisense oligonucleotide has at least 50% sequence identity to a reverse complement of a polynucleotide comprising 5 to 30 consecutive nucleotides within nucleotides 1 to 6333 of SEQ ID NO: 11086, and any variants, alleles, homologs, mutants, derivatives, fragments and complementary sequences thereof, thereby modulating function and/or expression of the ANGPTL7 polynucleotide in patient cells or tissues, in vivo or in vitro. In some embodiments, the oligonucleotide comprises SEQ ID NO: 11087. In some embodiments, the oligonucleotide comprises a sequence selected from SEQ ID NOS: 4413-11084. In some embodiments, the oligonucleotide comprises a sequence at least about 80%, 85%, 90%, or 95% identical to a sequence selected from SEQ ID NOS: 4413-11084.

In some embodiments, an oligonucleotide targets a natural sequence of ANGPTL7 polynucleotides, for example, nucleotides set forth in SEQ ID NO: 11085, and any variants, alleles, homologs, mutants, derivatives, fragments and complementary sequences thereto. In some embodiments, the oligonucleotide comprises a sequence selected from SEQ ID NOS: 4413-11084. In some embodiments, the oligonucleotide comprises a sequence at least about 80%, 85%, 90%, or 95% identical to a sequence selected from SEQ ID NOS: 4413-11084.

In some embodiments, an oligonucleotide targets a natural sequence of ANGPTL7 polynucleotides, for example, nucleotides set forth in SEQ ID NO: 11086, and any variants, alleles, homologs, mutants, derivatives, fragments and complementary sequences thereto. In some embodiments, the oligonucleotide comprises a sequence selected from SEQ ID NOS: 4413-11084. In some embodiments, the oligonucleotide comprises a sequence at least about 80%, 85%, 90%, or 95% identical to a sequence selected from SEQ ID NOS: 4413-11084.

In some embodiments, a composition comprises one or more antisense oligonucleotides which bind to sense ANGPTL7 polynucleotides. In some embodiments, the oligonucleotide comprises a sequence selected from SEQ ID NOS: 4413-11084. In some embodiments, the oligonucleotide comprises a sequence at least about 80%, 85%, 90%, or 95% identical to a sequence selected from SEQ ID NOS: 4413-11084. In some embodiments, the oligonucleotide comprises SEQ ID NO: 11087.

In some embodiments, the oligonucleotides comprise one or more modified or substituted nucleotides. In some embodiments, the oligonucleotides comprise one or more modified bonds. In some embodiments, the modified nucleotides comprise modified bases comprising phosphorothioate, methylphosphonate, peptide nucleic acids, 2'-0-methyl, methoxyethly, fluoro- or carbon, methylene or other locked nucleic acid (LNA) molecules. In some embodiments, the modified nucleotides are locked nucleic acid molecules, including a-L-LNA In some embodiments, the oligonucleotides are administered to a patient by topical application, inhalation, intranasally, subcutaneously, intramuscularly, intravenously, intraocularly or intraperitoneally.

In some embodiments, the oligonucleotides are administered in a pharmaceutical composition. A treatment regimen comprises administering the antisense compounds at least once to a patient; however, this treatment can be modified to include multiple doses over a period of time. The treatment can be combined with one or more other types of therapies.

In some embodiments, the oligonucleotides are encapsulated in a liposome or attached to a carrier molecule (e.g. cholesterol, TAT peptide).

In one aspect, provided herein is an RNA interference (RNAi) agent capable of inhibiting or modulating the expression of angiopoietin like 7 (ANGPTL7), wherein the RNAi agent comprises a double-stranded RNA(dsRNA) comprising a sense strand and an antisense strand, each strand having 14 to 30 nucleotides. In some embodiments, the dsRNA has a length of 17-30 nucleotide pairs. In some embodiments, the sense strand and antisense strand each have 17-30 nucleotides. In some embodiments, the sense strand comprises a sequence at least about 80%, 85%, 90%, 95%, or 100% identical to a sequence selected from SEQ ID NOS: 1-4412. In some embodiments, the antisense strand comprises a sequence at least about 80%, 85%, 90%, 95%, or 100% identical to the reverse complement of the sense strand. In some embodiments, the antisense strand comprises a sequence at least about 80%, 85%, 90%, 95%, or 100% identical to a sequence selected from SEQ ID NOS: 1-4412. In some embodiments, the sequence of the sense strand comprises SEQ ID NO: 11089 and the sequence of the antisense strand comprises SEQ ID NO: 11090. In some embodiments, the RNAi agent comprises one or more nucleotide modifications selected from the group consisting of LNA, HNA, CeNA, 2'-methoxyethyl, 2'-0-alkyl, 2'-0-allyl, 2'-C-allyl, 2'-fluoro, and 2'-deoxy. In some embodiments, the nucleotides are modified with either 2'-OCH$_3$ or 2'-F. In some embodiments, the RNAi agent further comprises at least one ligand. In some embodiments, the RNAi agent comprises one or more nucleotide modifications selected from the group consisting of 2'-0-methyl nucleotide, 2'-deoxyfluoro nucleotide, 2'-0-N-methylacetamido (2'-0-NMA) nucleotide, a 2'-0-dimethylaminoethoxyethyl (2'-0-DMAEOE) nucleotide, 2'-0-aminopropyl (2'-0-AP) nucleotide, and 2'-ara-F. In some embodiments, the RNAi agent comprises at least one phosphorothioate or methylphosphonate internucleotide linkage. In some embodiments, the nucleotide at the 1 position of the 5'-end of the antisense strand of the dsRNA is selected from the group consisting of A, dA, dU, U, and dT. In some embodiments, the base pair at the 1 position of the 5'-end of the dsRNA is an AU base pair.

In one aspect, provided herein is an RNA interference (RNAi) agent capable of inhibiting or modulating the expression of ANGPTL7, wherein the RNAi agent comprises a double-stranded RNA (dsRNA) comprising a sense strand and an antisense strand, each of the strands having 14 to 30 nucleotides, wherein the sense strand contains at least two motifs of three identical modifications on three consecutive nucleotides, a first of said sense strand motifs occurring at a cleavage site in the sense strand and a second of said sense strand motifs occurring at a different region of the sense strand that is separated from the first sense strand motif by at least one nucleotide; and wherein the antisense strand contains at least two motifs of three identical modifications on three consecutive nucleotides, a first of said antisense strand motifs occurring at or near the cleavage site in the antisense strand and a second of said antisense strand motifs occurring at a different region of the antisense strand that is separated from the first antisense strand motif by at least one nucleotide; wherein the modification in the first antisense strand motif is different than the modification in the second antisense strand motif. In some embodiments, at least one of the nucleotides occurring in the first sense strand motif forms a base pair with one of the nucleotides in the first antisense strand motif. In some embodiments, the dsRNA has 17-30 nucleotide base pairs. In some embodiments, the dsRNA has 17-19 nucleotide base pairs. In some embodiments, each strand has 17-23 nucleotides. In some embodiments, the modifications on the nucleotides of the sense strand and/or antisense strand are selected from the group consisting of LNA, HNA, CeNA, 2'-methoxyethyl, 2'-0-alkyl, 2'-0-allyl, 2' C-allyl, 2'-fluoro, 2'-deoxy, and combinations thereof. In some embodiments, the modifications on the nucleotides of the sense strand and/or antisense strand are 2'-OCH3 or 2'-F. In some embodiments, the RNAi agent further comprises a ligand attached to the 3' end of the sense strand.

In one aspect, provided herein is an RNA interference (RNAi) agent capable of inhibiting or modulating the expression of ANGPTL7, wherein the RNAi agent comprises a double-stranded RNA (dsRNA) comprising a sense strand and an antisense strand, each of the strands having 14 to 30 nucleotides, wherein the sense strand contains at least one motif of three 2'-F modifications on three consecutive nucleotides, one of said motifs occurring at or near the cleavage site in the sense strand; and wherein the antisense strand contains at least one motif of three 2'-0-methyl modifications on three consecutive nucleotides, one of said motifs occurring at or near the cleavage site in the antisense strand. In some embodiments, the sense strand comprises a sequence at least about 80%, 85%, 90%, 95%, or 100% identical to a sequence selected from SEQ ID NOS: 1-4412. In some embodiments, the antisense strand comprises a sequence at least about 80%, 85%, 90%, 95%, or 100% identical to the reverse complement of the sense strand. In some embodiments, the antisense strand comprises a sequence at least about 80%, 85%, 90%, 95%, or 100% identical to a sequence selected from SEQ ID NOS: 1-4412.

In one aspect, provided herein is a method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide 5 to 30 nucleotides in length, wherein said at least one antisense oligonucleotide has at least 50% sequence identity to a reverse complement of a polynucleotide comprising 5 to 30 consecutive nucleotides within nucleotides 1 to 2224 of SEQ ID NO: 11085; thereby modulating a function of and/or the expression of the angiopoietin like 7 (ANGPTL7) polynucleotide in patient cells or tissues, in vivo or in vitro.

In one aspect, provided herein is a method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide 5 to 30 nucleotides in length, wherein said antisense oligonucleotide has at least 50% sequence identity to an antisense oligonucleotide to the angiopoietin like 7 (ANGPTL7) polynucleotide; thereby modulating a function of and/or the expression of the angiopoietin like 7 (ANGPTL7) polynucleotide in patient cells or tissues, in vivo or in vitro.

In one aspect, provided herein is a method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide that targets a region of a natural antisense oligonucleotide of the angiopoietin like 7 (ANGPTL7) polynucleotide; thereby modulating a function of and/or the expression of the angiopoietin like 7 (ANGPTL7) polynucleotide in patient cells or tissues, in vivo or in vitro.

In one aspect, provided herein is a method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide 5 to 30 nucleotides in length; thereby modulating a function of and/or the expression of the ANGPTL7 polynucleotide in patient cells or tissues, in vivo or in vitro.

In some embodiments, the at least one antisense oligonucleotide comprises SEQ ID NO: 11087. In some embodiments, the at least one antisense oligonucleotide comprises SEQ ID NO: 11087. In some embodiments, the at least one antisense oligonucleotide comprises a sequence at least about 80%, 85%, 90%, 95% identical to SEQ ID NO: 11087. In some embodiments, a function of and/or the expression of the angiopoietin like 7 (ANGPTL7) is increased in vivo or in vitro with respect to a control oligonucleotide that does not target or specifically hybridize to ANGPTL7. In some embodiments, a function of and/or the expression of the angiopoietin like 7 (ANGPTL7) is decreased in vivo or in vitro with respect to a control oligonucleotide that does not target or specifically hybridize to ANGPTL7. In some embodiments, the at least one antisense oligonucleotide targets a natural antisense sequence of an angiopoietin like 7 (ANGPTL7) polynucleotide. In some embodiments, the at least one antisense oligonucleotide targets a nucleic acid sequence comprising coding and/or non-coding nucleic acid sequences of an angiopoietin like 7 (ANGPTL7) polynucleotide. In some embodiments, the at least one antisense oligonucleotide targets overlapping and/or non-overlapping sequences of an angiopoietin like 7 (ANGPTL7) polynucleotide. In some embodiments, the at least one antisense oligonucleotide comprises one or more modifications. In some embodiments, the one or more modifications is selected from: at least one modified sugar moiety, at least one modified internucleoside linkage, at least one modified nucleotide, and combinations thereof. In some embodiments, the one or more modifications comprise at least one modified sugar moiety selected from: a 2'-0-methoxy ethyl modified sugar moiety, a 2'-methoxy modified sugar moiety, a 2'-0-alkyl modified sugar moiety, a bicyclic sugar moiety, and combinations thereof. In some embodiments, the one or more modifications comprise at least one modified internucleoside linkage selected from: a phosphorothioate, 2'-Omethoxyethyl(MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof. In some embodiments, the one or more modifications comprise at least one modified nucleotide selected from: a peptide nucleic acid (PNA), a locked nucleic acid (LNA), an arabino-nucleic acid (FANA), an analogue, a derivative, and combinations thereof.

In one aspect, provided herein is a method of modulating a function of and/or the expression of an angiopoietin like 7 (ANGPTL7) gene in mammalian cells or tissues, in vivo or in vitro, the method comprising: contacting said cells or tissues with at least one short interfering RNA (siRNA) oligonucleotide 5 to 30 nucleotides in length, said at least one siRNA oligonucleotide being specific for an antisense polynucleotide of an angiopoietin like 7 (ANGPTL7) polynucleotide, wherein said at least one siRNA oligonucleotide has at least 50% sequence identity to a complementary sequence of at least about five consecutive nucleic acids of the antisense and/or sense nucleic acid molecule of the angiopoietin like 7 (ANGPTL7) polynucleotide; thereby modulating a function of and or the expression of angiopoietin like 7, (ANGPTL7) in mammalian cells or tissues in vivo or in vitro. In some embodiments, said oligonucleotide has at least 80% sequence identity to a sequence of at least about five consecutive nucleic acids that is complementary to the antisense and/or sense nucleic acid molecule of the angiopoietin like 7 (ANGPTL7) polynucleotide. In some embodiments, the at least one siRNA oligonucleotide comprises a sequence selected from SEQ ID NOS: 1-4412. In some embodiments, the at least one siRNA oligonucleotide comprises a sequence at least about 80%, 85%, 90%, 95%, or 100% identical to a sequence selected from SEQ ID NOS: 1-4412.

In one aspect, provided herein is a method of modulating a function of and/or the expression of angiopoietin like 7, (ANGPTL7) in mammalian cells or tissues, in vivo or in vitro, the method comprising: contacting said cells or tissues with at least one antisense oligonucleotide of about 5 to 30 nucleotides in length, the antisense oligonucleotide specific for noncoding and/or coding sequences of a sense and/or natural antisense strand of an angiopoietin like 7 (ANGPTL7) polynucleotide, wherein said at least one antisense oligonucleotide has at least 50% sequence identity to at least one nucleic acid sequence set forth as 1 to 2224 of SEQ ID NO: 11085 or its complement; thereby modulating the function and/or expression of the angiopoietin like 7 (AGNPTL7) in mammalian cells or tissues, in vivo or in vitro. In some embodiments, the at least one antisense oligonucleotide comprises SEQ ID NO: 11087. In some embodiments, the at least one antisense oligonucleotide comprises a sequence at least about 80%, 85%, 90%, 95% identical to SEQ ID NO:11087.

In one aspect, provided herein is a synthetic, modified oligonucleotide comprising at least one modification wherein the at least one modification is selected from: at least one modified sugar moiety; at least one modified intenucleotide linkage; at least one modified nucleotide, and combinations thereof; wherein said oligonucleotide is an antisense compound which hybridizes to and modulates the function and/or expression of an angiopoietin like 7 (ANGPTL7) polynucleotide in vivo or in vitro as compared to a control oligonucleotide that does not specifically hybridize to the ANGPTL7 polynucleotide. In some embodiments, the at least one modification comprises an internucleotide linkage selected from the group consisting of: phosphorothioate, alkylphosphonate, phosphorodithioate, alkylphosphonothioate, phosphoramidate, carbamate, carbonate, phosphate triester, acetamidate, carboxymethyl ester, and combinations thereof. In some embodiments, said oligonucleotide comprises at least one phosphorothioate internucleotide linkage. In some embodiments, said oligonucleotide comprises a backbone of phosphorothioate internucleotide linkages. In some embodiments, the oligonucleotide comprises at least one modified nucleotide, said modified nucleotide selected from: a peptide nucleic acid, a locked nucleic acid (LNA), and an analogue, derivative, and a combination thereof. In some embodiments, the oligonucleotide comprises a plurality of modifications, wherein said modifications comprise modified nucleotides selected from: phosphorothioate, alkylphosphonate, phosphorodithioate, alkylphosphonothioate, phosphoramidate, carbamate, carbonate, phosphate triester, acetamidate, carboxymethyl ester, and a combination thereof. In some embodiments, the oligonucleotide comprises a plurality of modifications, wherein said modifications comprise modified nucleotides selected from: peptide nucleic acids, locked nucleic acids (LNA), and analogues, derivatives, and a combination thereof. In some embodiments, the oligonucleotide comprises at least one modified sugar moiety selected from: a 2'-O-methoxyethyl modified sugar moiety, a 2'-methoxy modified sugar moiety, a 2-O-alkyl modified sugar moiety, a bicyclic sugar moiety, and a combination thereof. In some embodiments, the oligonucleotide comprises a plurality of modifications, wherein said modifications comprise modified sugar moieties selected from: a 2'-0-methoxyethyl modified sugar moiety, a 2-methoxy modified sugar moiety, a 2' 0-alkyl modified sugar moiety, a bicyclic sugar moiety, and a combination thereof. In some embodiments, the oligonucleotide is of at least about 5 to 30 nucleotides in length and hybridizes to an antisense and/or sense strand of an angiopoietin like 7 (ANGPTL7) polynucleotide, wherein said oligonucleotide has at least about 20% sequence identity to a complementary sequence of at least about five consecutive nucleic acids of the antisense and/or sense coding and/or noncoding nucleic acid sequences of the angiopoietin like 7 (ANGPTL7) polynucleotide. In some embodiments, the oligonucleotide has at least about 80% sequence identity to a complementary sequence of at least about five consecutive nucleic acids of the antisense and or sense coding and/or noncoding nucleic acid sequence of the angiopoietin like 7 (ANGPTL7) polynucleotide. In some embodiments, said oligonucleotide hybridizes to and modulates expression and/or function of at least one angiopoietin like 7 (ANGPTL7) polynucleotide, in vivo or in vitro, as compared to the control oligonucleotide. In some embodiments, the oligonucleotide comprises the sequence set forth as SEQ ID NO: 11087. In some embodiments, the at least one antisense oligonucleotide comprises SEQ ID NO: 11087. In some embodiments, the at least one antisense oligonucleotide comprises a sequence at least about 80%, 85%, 90%, or 95% identical to SEQ ID NO: 11087.

In one aspect, provided herein is a composition comprising one or more oligonucleotides specific for one or more angiopoietin like 7 (ANGPTL7) polynucleotides, said one or more oligonucleotides comprising an antisense sequence, complementary sequence, allele, homolog, isoform, variant, derivative, mutant, or fragment of the ANGPTL7 polynucleotide, or a combination thereof. In some embodiments, the one or more oligonucleotides have at least about 40% sequence identity as compared to the nucleotide sequence set forth as SEQ ID NO: 11087. In some embodiments, the oligonucleotide comprises the nucleotide sequence set forth as SEQ ID NO: 11087. In some embodiments, the one or more oligonucleotides comprises a sequence selected from SEQ ID NOS: 1-4412. In some embodiments, the one or more oligonucleotides comprises a sequence at least about 80%, 85%, 90%, 95%, or 100% identical to a sequence selected from SEQ ID NOS: 1-4412. In some embodiments, the one or more oligonucleotides comprises one or more modifications or substitutions. In some embodiments, the one or more modifications are selected from: phosphorothioate, methylphosphonate, peptide nucleic acid, locked nucleic acid (LNA) molecules, and combinations thereof.

In one aspect, provided herein is a method of preventing or treating a disease associated with at least one angiopoietin like 7 (ANGPTL7) polynucleotide and/or at least one encoded product thereof, the method comprising: administering to a subject in need thereof a therapeutically effective dose of at least one antisense oligonucleotide that binds to a natural antisense sequence of said at least one angiopoietin like 7 (ANGPTL7) polynucleotide and modulates expression of said at least one angiopoietin like 7 (ANGPTL7) polynucleotide; thereby preventing or treating the disease associated with the at least one angiopoietin like 7 (ANGPTL7) polynucleotide and or at least one encoded product thereof.

In one aspect, provided herein is a method of preventing or treating a disease associated with at least one angiopoietin like 7 (ANGPTL7) polynucleotide and/or at least one encoded product thereof, the method comprising: administering to a subject in need thereof a therapeutically effective dose of at least one antisense oligonucleotide that binds to a natural sense sequence of said at least one angiopoietin like 7 (ANGPTL7) polynucleotide and modulates expression of said at least one angiopoietin like 7 (ANGPTL7) polynucleotide; thereby preventing or treating the disease associated with the at least one angiopoietin like 7 (ANGPTL7) polynucleotide and or at least one encoded product thereof.

In some embodiments, a disease associated with the at least one angiopoietin like 7 (ANGPTL7) polynucleotide is selected from: a disease or disorder associated with abnormal function and/or expression of ANGPTL7, a disease or disorder associated with optic nerve damage, a disease or disorder associated with intraocular pressure, a degenerative retinal disease or disorder, an inflammatory eye disease or disorder, an allergic eye disease or disorder, a disease or disorder associated with degeneration or inflammation of the joints, a disease or disorder associated with abnormal lipid metabolism, cancer, Alzheimer's disease, dementia, stroke and brain ischemia. In some embodiments, the disease or disorder associated with optic nerve damage comprises primary open-angle glaucoma, primary angle-closure glaucoma, normal-tension glaucoma, pigmentary glaucoma, exfoliation glaucoma, juvenile glaucoma, congenital glaucoma, inflammatory glaucoma, phacogenic glaucoma, glaucoma secondary to intraocular hemorrhage, traumatic glaucoma, neovascular glaucoma, drug-induced glaucoma, toxic glaucoma, absolute glaucoma, ocular hypertension, or a combination thereof. In some embodiments, the disease or disorder associated with degeneration or inflammation of the joints comprises osteoarthritis, osteoarthrosis or a combination thereof. In some embodiments, the cancer is selected from lung cancer, epidermoid carcinoma, breast cancer, or a combination thereof.

In one aspect, provided herein is a method of identifying and selecting at least one oligonucleotide for in vivo administration comprising: identifying at least one oligonucleotide comprising at least five consecutive nucleotides which are complementary to ANGPTL7 or to a polynucleotide that is antisense to ANGPTL7; measuring the thermal melting point of a hybrid of an antisense oligonucleotide and the ANGPTL7 or the polynucleotide that is antisense to the ANGPTL7 under stringent hybridization conditions; and selecting at least one oligonucleotide for in vivo administration based on the information obtained.

In one aspect, provided herein is a method of treating a disease or condition mediated by ANGPTL7, the method comprising administering to a subject in need thereof an oligonucleotide comprising a sequence at least about 80%, 85%, 90%, 95%, or 100% identical to a sequence selected from SEQ ID NOS: 1-4412. In some embodiments, the oligonucleotide comprises a sequence selected from SEQ ID NOS: 1-4412. In some embodiments, the target is ANGPTL7. In some embodiments, the disease or condition comprises glaucoma (including, primary open-angle glaucoma, primary angle-closure glaucoma, normal-tension glaucoma, pigmentary glaucoma, exfoliation glaucoma, juvenile glaucoma, congenital glaucoma, inflammatory glaucoma, phacogenic glaucoma, glaucoma secondary to intraocular hemorrhage, traumatic glaucoma, neovascular glaucoma, drug-induced glaucoma, toxic glaucoma and absolute glaucoma), ocular hypertension, optic neuropathy or a combination thereof. In some embodiments, the oligonucleotide comprises dsRNA. In some embodiments, the oligonucleotide comprises a sequence at least about 80%, 85%, 90%, 95%, or 100% identical to a sequence selected from SEQ ID NOS: 1-4412. In some embodiments, the oligonucleotide comprises a sequence at least about 80%, 85%, 90%, 95%, or 100% identical to SEQ ID NO: 11087.

In one aspect, provided herein is a method of treating one or more disorders of the eye in a subject in need thereof comprising editing an ANGPTL7 gene in the subject wherein the one or more disorders of the eye comprises glaucoma or ocular hypertension. In some embodiments, the editing of the ANGPTL7 gene comprises administering CRISPR/cas9 to the subject. In some embodiments, the CRISPR/cas9 targets the ANGPTL7 gene. In some embodiments, the CRISPR/cas9 edits the ANGPTL7 gene to a loss of function mutation. In some embodiments, the loss of function mutation comprises a premature stop mutation. In some embodiments, the premature stop mutation occurs at amino acid position 177 according to the human protein sequence numbering. In some embodiments, the CRISPR/cas9 edits the ANGPTL7 gene to a missense mutation. In some embodiments, the missense mutation comprises a glutamine to histidine mutation. In some embodiments, the glutamine to histidine mutation occurs at amino acid position 175 according to the human protein sequence numbering. In some embodiments, the CRISPR/cas9 is delivered systemically to the subject. In some embodiments, the CRISPR/cas9 is delivered locally to the subject. In some embodiments, the CRISPR/cas9 is delivered locally to the eye of the subject. In some embodiments, the editing of the ANGPTL7 gene is efficacious in treating the one or more disorders of the eye. In some embodiments, the one or more disorders of the eye is glaucoma. In some embodiments, the subject has ocular hypertension. In some embodiments, imaging from the subject ocular hypertension demonstrates optic nerve damage. In some embodiments, the subject has received a first line treatment comprising topical ocular prostaglandin analogues, beta-adrenergic blockers, alpha-adrenergic agonists, and carbonic anhydrase inhibitors for the one or more disorders of the eye. In some embodiments, the editing of the ANGPTL7 gene causes a reduction in or modulation of the production of the gene product of ANGPTL7 in the subject. In some embodiments, the editing of the ANGPTL7 gene causes a reduction in the subject of intraocular pressure.

In one aspect, provided herein is a composition comprising CRISPR/cas9 that targets ANGPTL7 that is efficacious in treating glaucoma or ocular hypertension. In some embodiments, the CRISPR/cas9 edits the ANGPTL7 gene to a loss of function mutation. In some embodiments, the loss of function mutation comprises a premature stop mutation. In some embodiments, the premature stop mutation occurs at amino acid position 177 according to the human protein sequence numbering. In some embodiments, the CRISPR/cas9 edits the ANGPTL7 gene to a missense mutation. In some embodiments, the missense mutation comprises a glutamine to histidine mutation. In some embodiments, the glutamine to histidine mutation occurs at amino acid position 175 according to the human protein sequence numbering.

Disclosed herein, in some embodiments, are compositions comprising an oligonucleotide that targets Angiopoietin like 7 (ANGPTL7) and when administered to a subject in an effective amount decreases intraocular pressure, wherein the oligonucleotide comprises a small interfering RNA (siRNA) comprising a sense strand and an antisense strand, the antisense strand being complementary to a portion of a nucleic acid having the nucleoside sequence of SEQ ID NO: 11085, and each strand having 14 to 30 nucleotides. In some embodiments, the intraocular pressure is decreased by about 10% or more, as compared to prior to administration. Disclosed herein, in some embodiments, are compositions comprising an oligonucleotide that targets Angiopoietin like 7 (ANGPTL7) and when administered to a cell decreases expression of ANGPTL7, wherein the oligonucleotide comprises a small interfering RNA (siRNA) comprising a sense strand and an antisense strand, the antisense strand being complementary to a portion of a nucleic acid having the nucleoside sequence of SEQ ID NO: 11085, and each strand having 14 to 30 nucleotides. In some embodiments, the composition decreases expression of ANGPTL7 as compared to a baseline ANGPTL7 measurement. In some embodiments, the baseline ANGPLT7 measurement is measured before the composition is administered to the cell. In some embodiments, the composition decreases expression of ANGPLT7 by at least 10% relative to the baseline ANGPTL7 measurement. In some embodiments, the composition decreases expression of ANGPTL7 by at least 20% relative to the baseline ANGPTL7 measurement. In some embodiments, the composition decreases expression of ANGPLT7 by at least 30% relative to the baseline ANGPTL7 measurement. In some embodiments, the composition decreases expression of ANGPTL7 by at least 40% relative to the baseline ANGPTL7 measurement. In some embodiments, the composition decreases expression of ANGPLT7 by at least 50% relative to the baseline ANGPTL7 measurement. In some embodiments, the composition decreases expression of ANGPLT7 by at least 25% to 75% relative to the baseline ANGPTL7 measurement. In some embodiments, the baseline measurement is an ANGPLT7 protein measurement. In some embodiments, the baseline measurement is an ANGPLT7 mRNA measurement. In some embodiments, the expression of ANGPLT7 comprises ANGPTL7 mRNA expression. In some embodiments, the expression of ANGPLT7 comprises ANGPTL7 protein expression. In some embodiments, the siRNA binds with a human ANGPTL7 mRNA with no more than 2 mismatches in the antisense strand. In some embodiments, the siRNA binds with a human ANGPTL7 mRNA target site that does not harbor an SNP, with a minor allele frequency (MAF) greater or equal to 1% (pos. 2-18). In some embodiments, the sense strand and the antisense strand each comprise a seed region that is not identical to a seed region of a human miRNA. In some embodiments, the sense strand comprises a nucleoside sequence at least 85% identical to any one of SEQ ID NOS: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192. In some embodiments, the sense strand comprises the nucleoside sequence of any one of SEQ ID NOS: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192, or a sense strand sequence thereof having 1 or 2 nucleoside substitutions, additions, or deletions. In some embodiments, the sense strand comprises the nucleoside sequence of any one of SEQ ID NOS: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192. In some embodiments, the antisense strand comprises a nucleoside sequence at least 85% identical to any one of SEQ ID NOS: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398. In some embodiments, the antisense strand comprises the nucleoside sequence of any one of SEQ ID NOS: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398, or an antisense strand sequence thereof having 1 or 2 nucleoside substitutions, additions, or deletions. In some embodiments, the antisense strand comprises the nucleoside sequence of any one of SEQ ID NOS: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398. In some embodiments, the oligonucleotide comprises one or more modified internucleoside linkages. In some embodiments, the one or more modified internucleoside linkages comprise alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the one or more modified internucleoside linkages comprise a phosphorothioate linkage. In some embodiments, the oligonucleotide comprises 2-6 modified internucleoside linkages. In some embodiments, the oligonucleotide comprises one or more modified nucleosides. In some embodiments, the one or more modified nucleosides comprise a locked nucleic acid (LNA), hexitol nucleic acid (HLA), cyclohexene nucleic acid (CeNA), a 2',4' constrained ethyl, 2'-methoxyethyl, 2'-O-alkyl, 2'-O-allyl, 2'-O-allyl, 2'-fluoro, or 2'-deoxy, a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl(2'-O-AP) nucleoside, 2'-ara-F, or a combination thereof. In some embodiments, the one or more modified nucleosides comprise a 2' fluoro modified nucleoside. In some embodiments, the one or more modified nucleosides comprise a 2' O-methyl modified nucleoside. In some embodiments, the oligonucleotide comprises 15-23 modified nucleosides. In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the lipid comprises cholesterol. In some embodiments, the oligonucleotide comprises an arginine-glycine-aspartic acid (RGD) peptide attached at a 3' or 5' terminus of the oligonucleotide. In some embodiments, the RGD peptide comprises Cyclo(-Arg-Gly-Asp-D-Phe-Cys), Cyclo(-Arg-Gly-Asp-D-Phe-Lys), Cyclo(-Arg-Gly-Asp-D-Phe-azido), an amino benzoic acid derived RGD, or a combination thereof. In some embodiments, the oligonucleotide comprises an RGD peptide and a lipid attached at a 3' or 5' terminus of the oligonucleotide. In some embodiments, the sense strand comprises modification pattern 1S: 5'-NfsnsNfnNfnNfnNfnNfnNfnNfnNfnNfnNfnNfsnsn-3' (SEQ ID NO: 11381), modification pattern 2S: 5'-nsnsnnNfnNfnNfnNfnnnnnnnnnnnsnsn-3' (SEQ ID NO: 11382), modification pattern 3S: 5'-nsnsnnNfnNfnNfnNfnnnnnnnnnnnnsnsn-3' (SEQ ID NO: 11383), modification pattern 4S: 5'-NfsnsNfnNfnNfnNfnNfnNfnNfnNfnNfnNfnNfsnsnN-Lipid-3' (SEQ ID NO: 11384), or modification pattern 5S: 5'-nsnsnnNfnNfnNfnNfnnnnnnnnnnnsnsnN-Lipid-3' (SEQ ID NO: 11385); wherein "Nf" is a 2' fluoro-modified nucleoside, "n" is a 2' O-methyl modified nucleoside, "s" is a phosphorothioate linkage, and N comprises a nucleoside. In some embodiments, the antisense strand comprises modification pattern 1AS: 5'-nsNfsnNfnNfnNfnNfnnnNfnNfnNfnNfsnsn-3' (SEQ ID NO: 11386), modification pattern 2AS: 5'-nsNfsnnnNfnNfnNfnnnnNfnNfnnnsnsn-3' (SEQ ID NO: 11387), modification pattern 3AS: 5'-nsNfsnnnNfnnnnnnnNfnNfnnnsnsn-3' (SEQ ID NO: 11388), or modification pattern 4AS: 5'-nsNfsnNfnNfnnnnnnnnNfnNfnnnsnsn-3' (SEQ ID NO: 11389); wherein "Nf" is a 2' fluoro-modified nucleoside, "n" is a 2' O-methyl modified nucleoside, and "s" is a phosphorothioate linkage. In some embodiments, the sense strand comprises a nucleoside sequence at least 85% identical the sense strand sequence of an siRNA in any of Tables 5-13. In some embodiments, the sense strand comprises the sense strand sequence of an siRNA in any of Tables 5-13. In some embodiments, the sense strand comprises the nucleoside sequence of any one of SEQ ID NOS: 11094, 11095, 11096, 11097, 11098, 11099, 11100, 11101, 11102, 11103, 11104, 11105, 11106, 11109, 11110, 11113, 11116, 11118, 11119, 11121, 11122, 11123, 11124, 11125, 11126, 11127, 11128, 11129, 11130, 11132, 11133, 11134, 11135, 11136, 11139, 11140, 11143, 11144, 11145, 11146, 11147, 11148, 11149, 11150, 11151, 11152, 11153, 11154, 11155, 11156, 11157, 11158, 11159, 11160, 11161, 11162, 11163, 11164, 11165, 11166, 11167, 11168, 11169, 11170, 11171, 11172, 11173, 11174, 11175, 11176, 11177, 11178, 11180, 11181, 11182, 11183, 11184, 11185, 11186, 11187, 11188, 11189, 11191, 11193, 11195, 11196, 11198, 11199, 11200, 11201, 11203, 11204, 11205, 11207, 11208, 11210, 11211, or 11212, or a sense strand sequence thereof having 1 or 2 nucleoside substitutions, additions, or deletions. In some embodiments, the sense strand comprises the nucleoside sequence of any one of SEQ ID NOS: 11094, 11095, 11096, 11097, 11098, 11099, 11100, 11101, 11102, 11103, 11104, 11105, 11106, 11109, 11110, 11113, 11116, 11118, 11119, 11121, 11122, 11123, 11124, 11125, 11126, 11127, 11128, 11129, 11130, 11132, 11133, 11134, 11135, 11136, 11139, 11140, 11143, 11144, 11145, 11146, 11147, 11148, 11149, 11150, 11151, 11152, 11153, 11154, 11155, 11156, 11157, 11158, 11159, 11160, 11161, 11162, 11163, 11164, 11165, 11166, 11167, 11168, 11169, 11170, 11171, 11172, 11173, 11174, 11175, 11176, 11177, 11178, 11180, 11181, 11182, 11183, 11184, 11185, 11186, 11187, 11188, 11189, 11191, 11193, 11195, 11196, 11198, 11199, 11200, 11201, 11203, 11204, 11205, 11207, 11208, 11210, 11211, or 11212. In some embodiments, the antisense strand comprises a nucleoside sequence at least 85% identical the antisense strand sequence of an siRNA in any of Tables 5-13. In some embodiments, the antisense strand comprises the antisense strand sequence of an siRNA in any of Tables 5-13. In some embodiments, the antisense strand comprises the nucleoside sequence of any one of SEQ ID NOS: 11214, 11215, 11216, 11217, 11218, 11219, 11220, 11221, 11222, 11223, 11224, 11225, 11226, 11229, 11230, 11233, 11236, 11238, 11239, 11241, 11242, 11243, 11244, 11245, 11246, 11247, 11248, 11249, 11250, 11252, 11253, 11254, 11255, 11256, 11259, 11260, 11263, 11264, 11265, 11266, 11267, 11268, 11269, 11270, 11271, 11272, 11273, 11274, 11275, 11276, 11277, 11278, 11279, 11280, 11281, 11282, 11283, 11284, 11285, 11286, 11287, 11288, 11289, 11290, 11291, 11292, 11293, 11294, 11295, 11296, 11297, 11298, 11300, 11301, 11302, 11303, 11304, 11305, 11306, 11307, 11308, 11309, 11311, 11313, 11315, 11316, 11318, 11319, 11320, 11321, 11323, 11324, 11325, 11327, 11328, 11330, 11331, or 11332, or an antisense strand sequence thereof having 1 or 2 nucleoside substitutions, additions, or deletions. In some embodiments, the antisense strand comprises the nucleoside sequence of any one of SEQ ID NOS: 11214, 11215, 11216, 11217, 11218, 11219, 11220, 11221, 11222, 11223, 11224, 11225, 11226, 11229, 11230, 11233, 11236, 11238, 11239, 11241, 11242, 11243, 11244, 11245, 11246, 11247, 11248, 11249, 11250, 11252, 11253, 11254, 11255, 11256, 11259, 11260, 11263, 11264, 11265, 11266, 11267, 11268, 11269, 11270, 11271, 11272, 11273, 11274, 11275, 11276, 11277, 11278, 11279, 11280, 11281, 11282, 11283, 11284, 11285, 11286, 11287, 11288, 11289, 11290, 11291, 11292, 11293, 11294, 11295, 11296, 11297, 11298, 11300, 11301, 11302, 11303, 11304, 11305, 11306, 11307, 11308, 11309, 11311, 11313, 11315, 11316, 11318, 11319, 11320, 11321, 11323, 11324, 11325, 11327, 11328, 11330, 11331, or 11332. In some embodiments, the sense strand or the antisense strand comprises a 3' overhang of at least 2 nucleotides. In some embodiments, the composition is a pharmaceutical composition. In some embodiments, the composition is sterile. Some embodiments include a pharmaceutically acceptable carrier. In some embodiments, the pharmaceutically acceptable carrier comprises water, a buffer, or a saline solution.

Disclosed herein, in some embodiments, are methods of treating an ocular disorder in a subject in need thereof, the method comprising administering to the subject a composition comprising an oligonucleotide that targets ANGPTL7. In some embodiments, the ocular disorder comprises a glaucoma. In some embodiments, the composition decreases intraocular pressure in an eye of the subject relative to a baseline intraocular pressure measurement obtained from the subject prior to administering the composition to the subject. In some embodiments, the sense strand comprises a nucleoside sequence at least 85% identical to any one of SEQ ID NOS: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192. In some embodiments, the sense strand comprises the nucleoside sequence of any one of SEQ ID NOS: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192, or a sense strand sequence thereof having 1 or 2 nucleoside substitutions, additions, or deletions. In some embodiments, the sense strand comprises the nucleoside sequence of any one of SEQ ID NOS: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192. In some embodiments, the antisense strand comprises a nucleoside sequence at least 85% identical to any one of SEQ ID NOS: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398. In some embodiments, the antisense strand comprises the nucleoside sequence of any one of SEQ ID NOS: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398, or an antisense strand sequence thereof having 1 or 2 nucleoside substitutions, additions, or deletions. In some embodiments, the antisense strand comprises the nucleoside sequence of any one of SEQ ID NOS: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398. In some embodiments, the sense strand comprises modification pattern 1S: 5'-NfsnsNfnNfnNfNfNfnNfnNfnNfnNfnNfsnsn-3' (SEQ ID NO: 11381), modification pattern 2S: 5'-nsnsnnNfnNfNfNfnnnnnnnnnnnsnsn-3' (SEQ ID NO: 11382), modification pattern 3S: 5'-nsnsnnNfnNfnNfnnnnnnnnnnnsnsn-3' (SEQ ID NO: 11383), modification pattern 4S: 5'-NfsnsNfnNfnNfnNfNfnNfnNfnNfnNfnNfsnsnN-Lipid-3' (SEQ ID NO: 11384), or modification pattern 5S: 5'-nsnsnnNfnNfNfNfnnnnnnnnnnnsnsnN-Lipid-3' (SEQ ID NO: 11385); wherein "Nf" is a 2' fluoro-modified nucleoside, "n" is a 2' O-methyl modified nucleoside, "s" is a phosphorothioate linkage, and N comprises a nucleoside. In some embodiments, the antisense strand comprises modification pattern 1AS: 5'-nsNfsnNfnNfnNfnNfnNfnnnNfnNfnNfnsnsn-3' (SEQ ID NO: 11386), modification pattern 2AS: 5'-nsNfsnnnNfnNfNfnnnnNfnNfnnnsnsn-3' (SEQ ID NO: 11387), modification pattern 3AS: 5'-nsNfsnnnNfnnnnnnnnNfnNfnnnsnsn-3' (SEQ ID NO: 11388), or modification pattern 4AS: 5'-nsNfsnNfnNfnnnnnnnnNfnNfnnnsnsn-3' (SEQ ID NO: 11389); wherein "Nf" is a 2' fluoro-modified nucleoside, "n" is a 2' O-methyl modified nucleoside, and "s" is a phosphorothioate linkage. In some embodiments, the sense strand comprises a nucleoside sequence at least 85% identical the sense strand sequence of an siRNA in any of Tables 5-13. In some embodiments, the sense strand comprises the sense strand sequence of an siRNA in any of Tables 5-13. In some embodiments, the sense strand comprises the nucleoside sequence of any one of SEQ ID NOS: 11094, 11095, 11096, 11097, 11098, 11099, 11100, 11101, 11102, 11103, 11104, 11105, 11106, 11109, 11110, 11113, 11116, 11118, 11119, 11121, 11122, 11123, 11124, 11125, 11126, 11127, 11128, 11129, 11130, 11132, 11133, 11134, 11135, 11136, 11139, 11140, 11143, 11144, 11145, 11146, 11147, 11148, 11149, 11150, 11151, 11152, 11153, 11154, 11155, 11156, 11157, 11158, 11159, 11160, 11161, 11162, 11163, 11164, 11165, 11166, 11167, 11168, 11169, 11170, 11171, 11172, 11173, 11174, 11175, 11176, 11177, 11178, 11180, 11181, 11182, 11183, 11184, 11185, 11186, 11187, 11188, 11189, 11191, 11193, 11195, 11196, 11198, 11199, 11200, 11201, 11203, 11204, 11205, 11207, 11208, 11210, 11211, or 11212, or a sense strand sequence thereof having 1 or 2 nucleoside substitutions, additions, or deletions. In some embodiments, the sense strand comprises the nucleoside sequence of any one of SEQ ID NOS: 11094, 11095, 11096, 11097, 11098, 11099, 11100, 11101, 11102, 11103, 11104, 11105, 11106, 11109, 11110, 11113, 11116, 11118, 11119, 11121, 11122, 11123, 11124, 11125, 11126, 11127, 11128, 11129, 11130, 11132, 11133, 11134, 11135, 11136, 11139, 11140, 11143, 11144, 11145, 11146, 11147, 11148, 11149, 11150, 11151, 11152, 11153, 11154, 11155, 11156, 11157, 11158, 11159, 11160, 11161, 11162, 11163, 11164, 11165, 11166, 11167, 11168, 11169, 11170, 11171, 11172, 11173, 11174, 11175, 11176, 11177, 11178, 11180, 11181, 11182, 11183, 11184, 11185, 11186, 11187, 11188, 11189, 11191, 11193, 11195, 11196, 11198, 11199, 11200, 11201, 11203, 11204, 11205, 11207, 11208, 11210, 11211, or 11212. In some embodiments, the antisense strand comprises a nucleoside sequence at least 85% identical the antisense strand sequence of an siRNA in any of Tables 5-13. In some embodiments, the antisense strand comprises the antisense strand sequence of an siRNA in any of Tables 5-13. In some embodiments, the antisense strand comprises the nucleoside sequence of any one of SEQ ID NOS: 11214, 11215, 11216, 11217, 11218, 11219, 11220, 11221, 11222, 11223, 11224, 11225, 11226, 11229, 11230, 11233, 11236, 11238, 11239, 11241, 11242, 11243, 11244, 11245, 11246, 11247, 11248, 11249, 11250, 11252, 11253, 11254, 11255, 11256, 11259, 11260, 11263, 11264, 11265, 11266, 11267, 11268, 11269, 11270, 11271, 11272, 11273, 11274, 11275, 11276, 11277, 11278, 11279, 11280, 11281, 11282, 11283, 11284, 11285, 11286, 11287, 11288, 11289, 11290, 11291, 11292, 11293, 11294, 11295, 11296, 11297, 11298, 11300, 11301, 11302, 11303, 11304, 11305, 11306, 11307, 11308, 11309, 11311, 11313, 11315, 11316, 11318, 11319, 11320, 11321, 11323, 11324, 11325, 11327, 11328, 11330, 11331, or 11332, or an antisense strand sequence thereof having 1 or 2 nucleoside substitutions, additions, or deletions. In some embodiments, the antisense strand comprises the nucleoside sequence of any one of SEQ ID NOS: 11214, 11215, 11216, 11217, 11218, 11219, 11220, 11221, 11222, 11223, 11224, 11225, 11226, 11229, 11230, 11233, 11236, 11238, 11239, 11241, 11242, 11243, 11244, 11245, 11246, 11247, 11248, 11249, 11250, 11252, 11253, 11254, 11255, 11256, 11259, 11260, 11263, 11264, 11265, 11266, 11267, 11268, 11269, 11270, 11271, 11272, 11273, 11274, 11275, 11276, 11277, 11278, 11279, 11280, 11281, 11282, 11283, 11284, 11285, 11286, 11287, 11288, 11289, 11290, 11291, 11292, 11293, 11294, 11295, 11296, 11297, 11298, 11300, 11301, 11302, 11303, 11304, 11305, 11306, 11307, 11308, 11309, 11311, 11313, 11315, 11316, 11318, 11319, 11320, 11321, 11323, 11324, 11325, 11327, 11328, 11330, 11331, or 11332. In some embodiments, the oligonucleotide comprises a cholesterol moiety attached at a 3' or 5' terminus of the oligonucleotide. In some embodiments, the oligonucleotide comprises a lipid attached at a 3' or 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the lipid comprises cholesterol. In some embodiments, the oligonucleotide comprises an arginine-glycine-aspartic acid (RGD) peptide attached at a 3' or 5' terminus of the oligonucleotide. In some embodiments, the RGD peptide comprises Cyclo(-Arg-Gly-Asp-D-Phe-Cys), Cyclo(-Arg-Gly-Asp-D-Phe-Lys), Cyclo(-Arg-Gly-Asp-D-Phe-azido), an amino benzoic acid derived RGD, or a combination thereof.

DETAILED DESCRIPTION

Figure 1A:
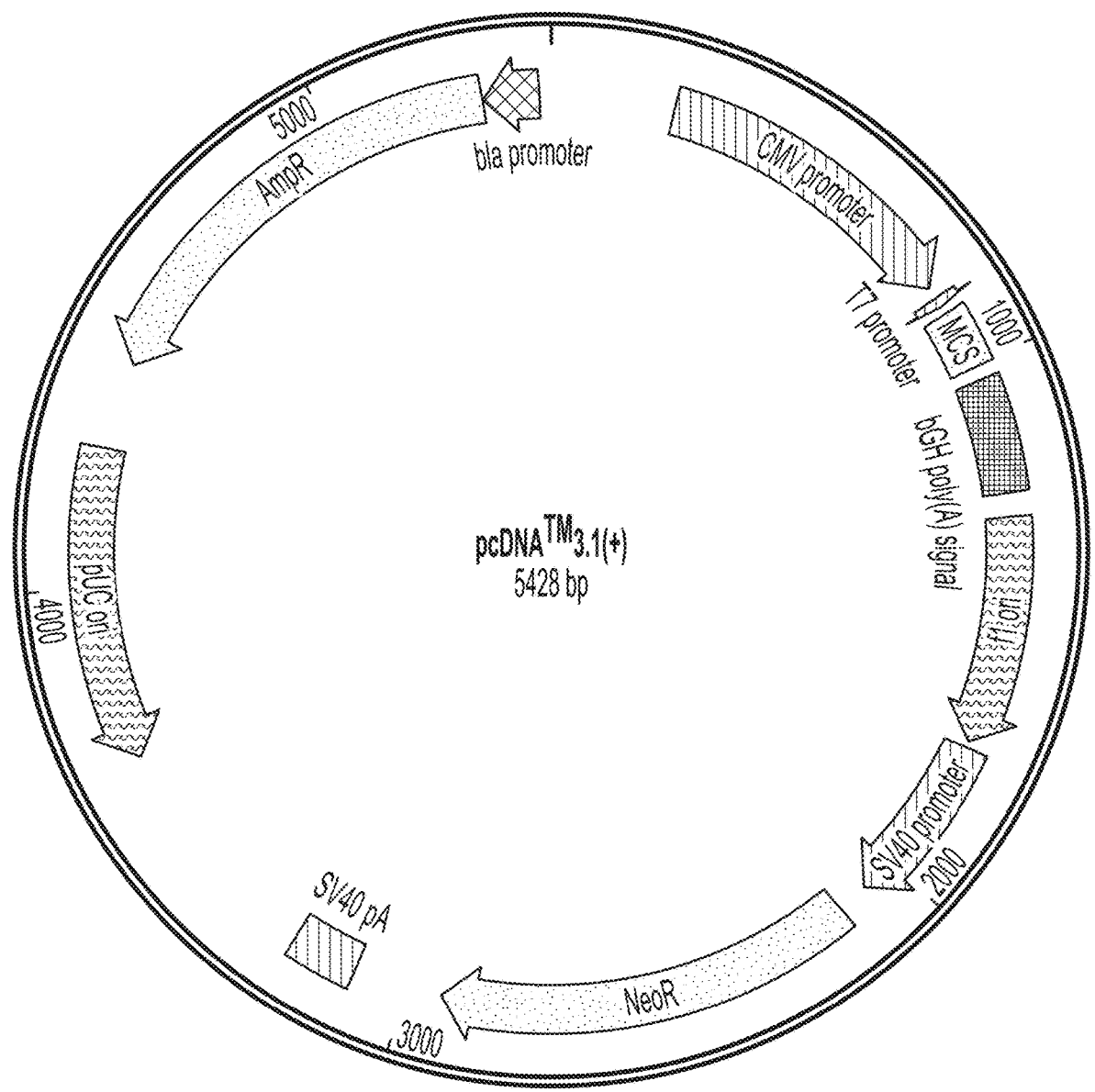
FIGS. 1A-1D show an empty plasmid construct (FIG. 1A) used in accordance with some embodiments, GFP tagged plasmid construct (FIG. 1B), a representative ANGPTL7 pre-mRNA encoding construct (FIG. 1C) and a representative ANGPTL7 CDS encoding construct (FIG. 1D).
Figure 1B:
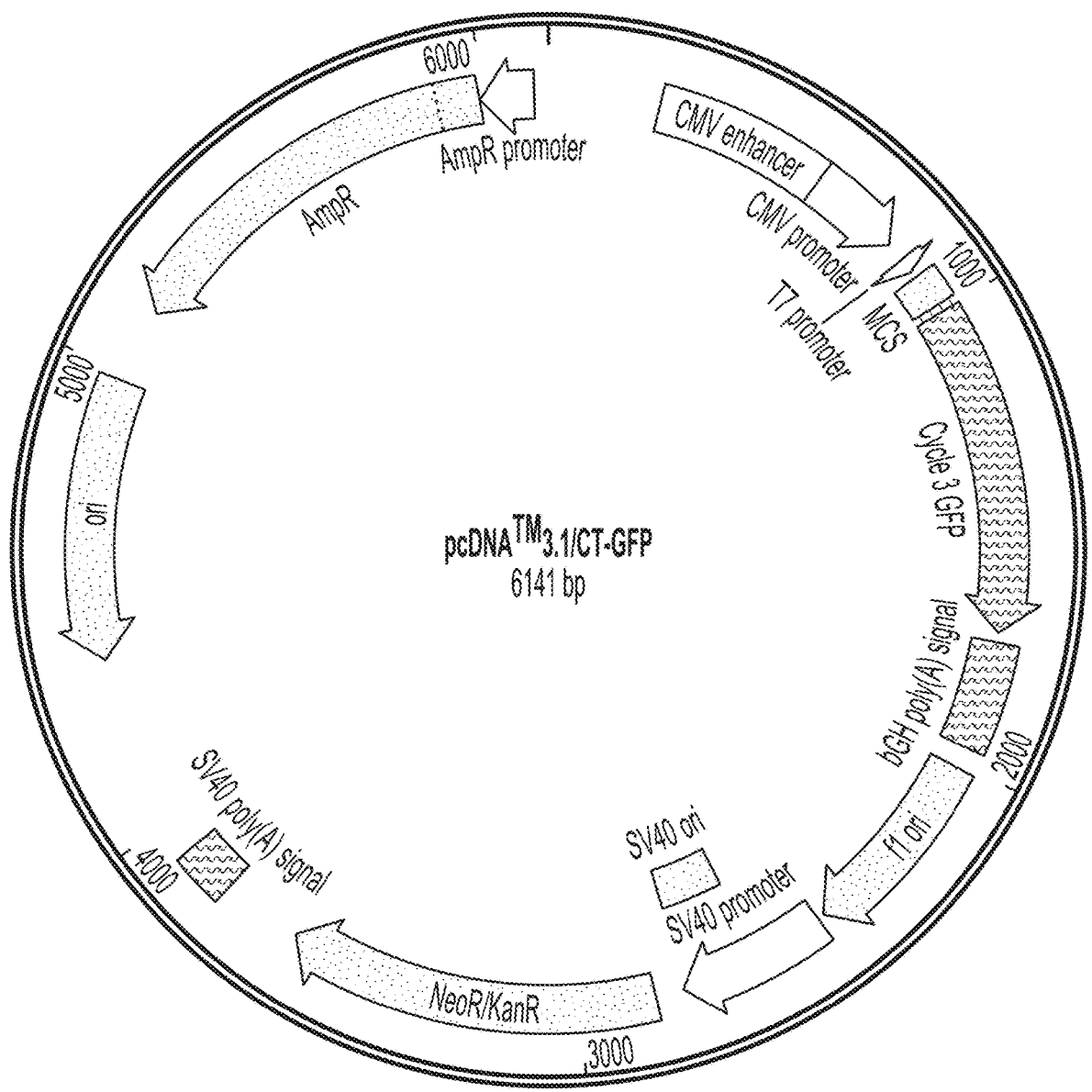
Figure 1C:
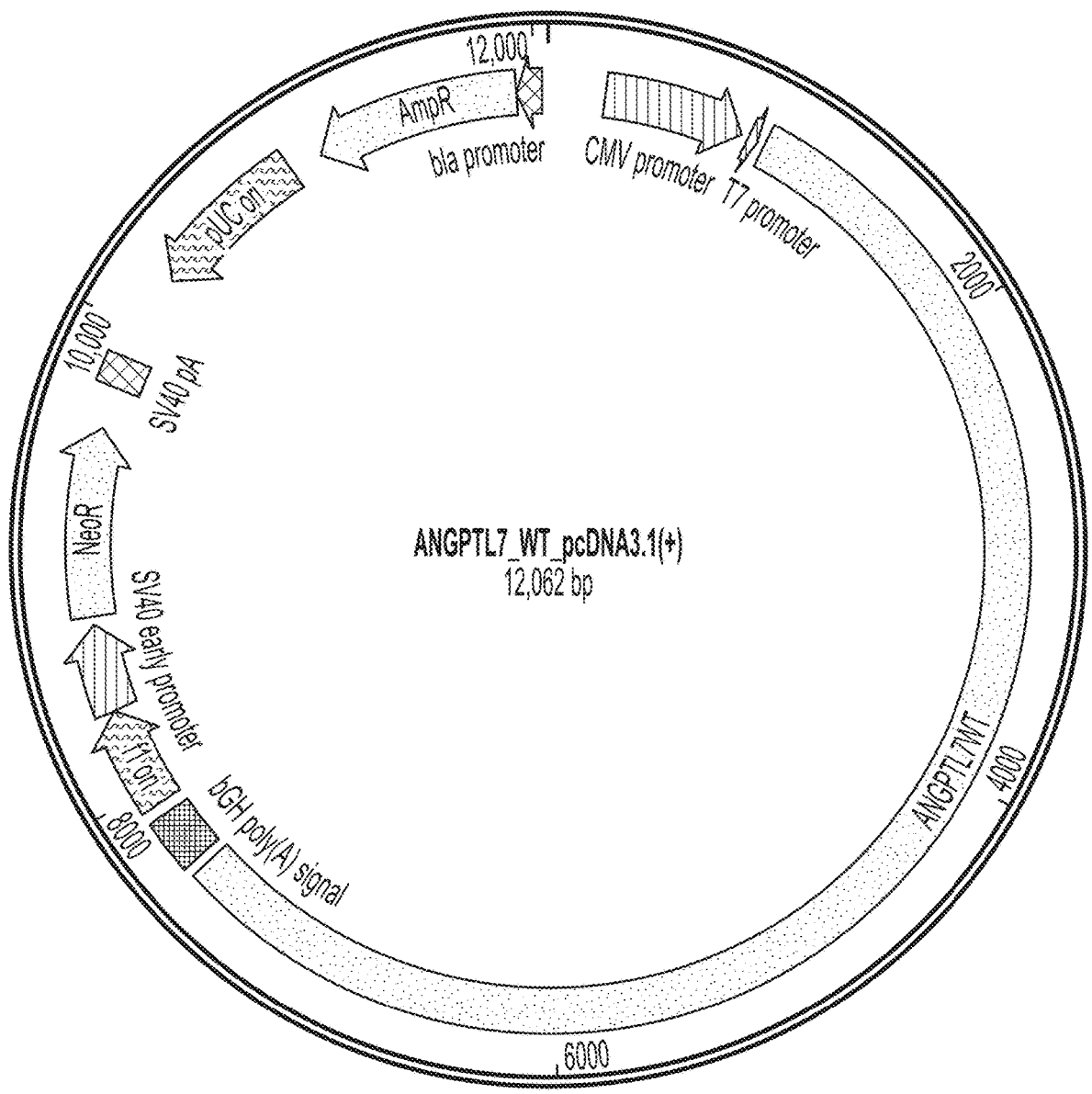
Figure 1D:
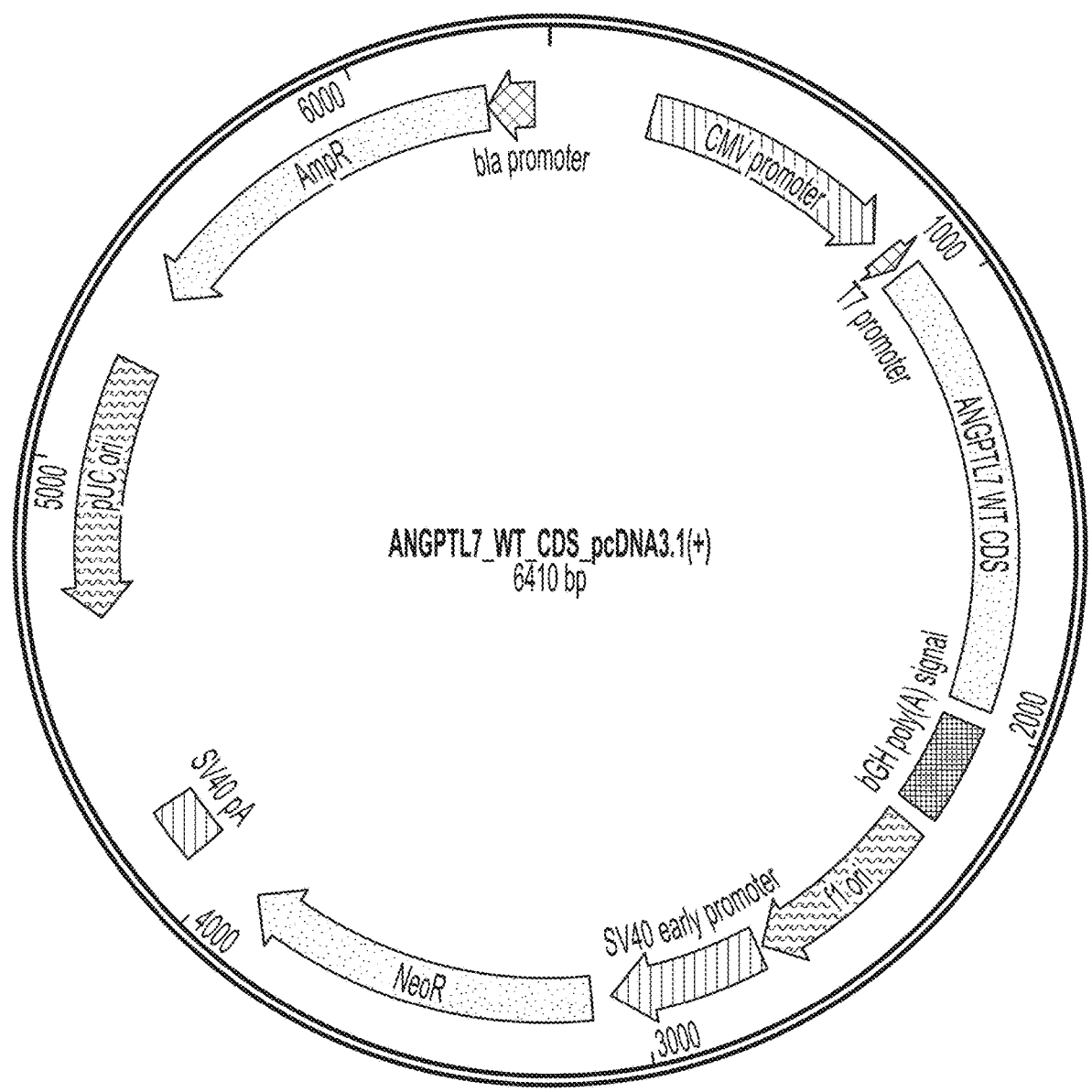

Glaucoma is the leading cause of irreversible blindness in the world, with an approximate 1-2% prevalence worldwide in individuals >40 years of age. There are several subtypes of glaucoma, but two subtypes are dominant: primary open angle glaucoma (POAG) and primary angle closure glaucoma (PACG). POAG accounts for about 90% of glaucoma cases in the US and the majority of these cases occur in the context of ocular hypertension (OHT). In some populations (i.e. Asian populations) the majority of glaucoma occurs in the context of normal intraocular pressure (normal-tension glaucoma, NTG).

Glaucoma is generally characterized by blocked outflow of the aqueous humor through the conventional outflow pathway. The conventional outflow pathway is comprised of the trabecular meshwork (TM) and Schlemm's canal at the base of the cornea. There is also anon-conventional outflow pathway which involves uveoscleral drainage and accounts for a fraction of the aqueous humor outflow from the anterior compartment of the eye. Blockage of the TM/Schlemm's canal (conventional pathway) restricts aqueous humor outflow leading to increased pressure in the anterior chamber which translates to increased pressure in the posterior chamber and optic nerve degeneration and damage.

Treatments for glaucoma aim to lower intraocular pressure (IOP) to target levels (generally a 20-50% reduction in IOP). Despite normal IOP, treatment of NTG also revolves around lowering IOP. Several classes of IOP-lowering medication are used, including prostaglandin analogues (typically the first-line therapy), beta-adrenergic blockers, alpha-adrenergic agonists, and carbonic anhydrase inhibitors. These drugs are often ineffective and surgical methods (trabeculoplasty/trabeculotomy) are employed. However, the beneficial effects of trabeculoplasty/trabeculotomy decrease over time such that there is an approximate 10% failure rate per year.

Angiopoietin-like proteins (ANGPTLs) are a family of eight proteins with structural and functional similarities to angiopoietins, comprised of an N-terminal coiled-coil domain which mediates homo-oligomerization and a C-terminal fibrinogen domain. ANGPTLs are widely expressed in the liver, vasculature and hematopoietic systems, and serve important roles in inflammation, lipid metabolism, angiogenesis and extracellular matrix (ECM) formation.

ANGPTL7 was originally discovered in human corneal cDNA libraries and named cornea-derived transcript 6 (CDT6). Immunohistochemistry reveals ANGPTL7 staining in multiple tissues in the eye. ANGPTL7 is overexpressed in the aqueous humor of patients with glaucoma and is upregulated by glaucomatous conditions such as TGFβ and dexamethasone exposure. Nonetheless, the molecular function of ANGPTL7 in eye health and disease is not well understood.

The terminology used herein is for the purpose of describing particular embodiments only and is not intended to be limiting. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. In some cases, "about" can mean a range of up to 20%, up to 10%, up to 5%, and up to 1% of a given value. In some cases, particularly with respect to biological systems or processes, the term can mean within an order of magnitude, e.g., within 5-fold, or within 2-fold, of a value. Where particular values are described in the application and claims, unless otherwise stated the term "about" meaning within an acceptable error range for the particular value should be assumed.

In some embodiments, the term "mRNA" means the presently known mRNA transcript(s) of a targeted gene, and any further transcripts which may be elucidated.

In some embodiments, "dsRNA", "siRNA", and "siRNA agent" are used interchangeably as agents that can mediate silencing of a target RNA, e.g., mRNA, e.g., a transcript of a gene that encodes a protein. In some cases, the target RNA is ANGPTL7. Such mRNA may also be referred to herein as mRNA to be silenced. Such a gene is also referred to as a target gene. In some cases, the RNA to be silenced is an endogenous gene or a pathogen gene. In addition, RNAs other than mRNA, e.g., tRNAs, and viral RNAs, can also be targeted.

In some embodiments, the phrase "mediates RNAi" refers to the ability to silence, in a sequence specific manner, a target RNA. While not wishing to be bound by theory, it is believed that silencing uses the RNAi machinery or process and a guide RNA, e.g., an siRNA agent.

In some embodiments, "specifically hybridizable" and "complementary" are terms which are used to indicate a sufficient degree of complementarity such that stable and specific binding occurs between a compound described herein and a target RNA molecule.

Specific binding may require a sufficient degree of complementarity to avoid non-specific binding of the oligomeric compound to non-target sequences under conditions in which specific binding is desired, i.e., under physiological conditions in the case of assays or therapeutic treatment, or in the case of in vitro assays, under conditions in which the assays are performed. The non-target sequences may differ by at least 5 nucleotides.

In some embodiments, a dsRNA agent is "sufficiently complementary" to a target RNA, e.g., a target mRNA, such that the dsRNA agent silences production of protein encoded by the target mRNA. In some embodiments, the dsRNA agent is "exactly complementary" to a target RNA, e.g., the target RNA and the dsRNA duplex agent anneal, for example to form a hybrid made exclusively of Watson-Crick base pairs in the region of exact complementarity. A "sufficiently complementary" target RNA can include an internal region (e.g., of at least 10 nucleotides) that is exactly complementary to a target RNA. Moreover, in some embodiments, the dsRNA agent specifically discriminates a single-nucleotide difference. In this case, the dsRNA agent only mediates RNAi if exact complementary is found in the region (e.g., within 7 nucleotides of) the single-nucleotide difference.

In some embodiments, the term "oligonucleotide" refers to a nucleic acid molecule (RNA or DNA) for example of length less than 100, 200, 300, or 400 nucleotides.

In some embodiments, "antisense oligonucleotides" or "antisense compound" is meant as an RNA or DNA molecule that binds to another RNA or DNA (target RNA, DNA). For example, if it is an RNA oligonucleotide it binds to another RNA target by means of RNA-RNA interactions and alters the activity of the target RNA. An antisense oligonucleotide can upregulate or downregulate expression and/or function of a particular polynucleotide. The definition is meant to include any foreign RNA or DNA molecule which is useful from a therapeutic, diagnostic, or other viewpoint. Such molecules include, for example, antisense RNA and DNA molecules, interference RNA (RNAi), micro RNA, decoy RNA molecules, siRNA, enzymatic RNA, therapeutic editing RNA and agonist and antagonist RNA, antisense oligomeric compounds, antisense oligonucleotides, external guide sequence (EGS) oligonucleotides, alternate splicers, primers, probes, and other oligomeric compounds that hybridize to at least a portion of the target nucleic acid. As such, these compounds may be introduced in the form of single-stranded, double-stranded, partially single-stranded, or circular oligomeric compounds.

In some embodiments, the term "oligonucleotide" refers to an oligomer or polymer of ribonucleic acid (RNA) or deoxyribonucleic acid (DNA) or mimetics thereof. The term "oligonucleotide", also includes linear or circular oligomers of natural and/or modified monomers or linkages, including deoxyribonucleosides, ribonucleosides, substituted and alpha-anomeric forms thereof, peptide nucleic acids (PNA), locked nucleic acids (LNA), phosphorothioate, methylphosphonate, and the like. Oligonucleotides are capable of specifically binding to a target polynucleotide by way of a regular pattern of monomer-to-monomer interactions, such as Watson-Crick type of base pairing, Hoogsteen or reverse Hoogsteen types of base pairing, or the like.

In some embodiments, the oligonucleotide is "chimeric", that is, composed of different regions. "Chimeric" oligonucleotides contain two or more chemical regions, for example, DNA region(s), RNA region(s), PNA region(s), etc. Each chemical region is made up of at least one monomer unit, i.e., a nucleotide in the case of an oligonucleotides compound. These oligonucleotides typically comprise at least one region wherein the oligonucleotide is modified in order to exhibit one or more desired properties. The desired properties of the oligonucleotide include, but are not limited, for example, to increased resistance to nuclease degradation, increased cellular uptake, and/or increased binding affinity for the target nucleic acid. Different regions of the oligonucleotide may therefore have different properties. Chimeric oligonucleotides can be formed as mixed structures of two or more oligonucleotides, modified oligonucleotides, oligonucleosides and/or oligonucleotide analogs.

The oligonucleotide can comprise or be composed of regions that can be linked in "register", that is, when the monomers are linked consecutively, as in native DNA, or linked via spacers. The spacers are intended to constitute a covalent "bridge" between the regions and have, in some cases, a length not exceeding about 100 carbon atoms. The spacers may carry different functionalities, for example, having positive or negative charge, carry special nucleic acid binding properties (intercalators, groove binders, toxins, fluorophores etc.), being lipophilic, inducing special secondary structures like, for example, alanine containing peptides that induce alpha-helices.

In some embodiments, "ANGPTL7" and "angiopoietin like 7" are inclusive of all family members, mutants, alleles, fragments, species, coding and noncoding sequences, sense and antisense polynucleotide strands, etc. of the ANGPTL7 transcript (NM_021146; SEQ ID NO: 11085). In some embodiments, "ANGPTL7" and "angiopoietin like 7" are used interchangeably in the present application.

In some embodiments, "oligonucleotide specific for" or "oligonucleotide which targets" refers to an oligonucleotide having a sequence (i) capable of forming a stable complex with a portion of the targeted gene, or (ii) capable of forming a stable duplex with a portion of a mRNA transcript of the targeted gene. Stability of the complexes and duplexes can be determined by theoretical calculations and/or in vitro assays.

In some embodiments, the term "target nucleic acid" encompasses DNA, RNA (including pre-mRNA and mRNA) transcribed from such DNA, and also cDNA derived from such RNA, coding, noncoding sequences, sense and antisense polynucleotides. The specific hybridization of an oligomeric compound with its target nucleic acid interferes with the normal function of the nucleic acid. This modulation of function of a target nucleic acid by compounds, which specifically hybridize to it, is generally referred to as "antisense". The functions of DNA that are modulated include, for example, replication and transcription. The functions of RNA that are modulated, include all vital functions such as, for example, translocation of the RNA to the site of protein translation, translation of protein from the RNA, splicing of the RNA to yield one or more mRNA species, and catalytic activity which may be engaged in or facilitated by the RNA. The overall effect of such interference with target nucleic acid function is modulation of the expression of an encoded product or oligonucleotides.

RNA interference "RNAi" is mediated by double stranded RNA (dsRNA) molecules that have sequence-specific homology to their "target" nucleic acid sequences. In certain embodiments, the mediators are 5-25 nucleotide "small interfering" RNA duplexes (siRNAs). The siRNAs are derived from the processing of dsRNA by an RNase enzyme known as Dicer. siRNA duplex products are recruited into a multi-protein siRNA complex termed RISC (RNA Induced Silencing Complex). Without wishing to be bound by any particular theory, a RISC is then believed to be guided to a target nucleic acid (suitably mRNA), where the siRNA duplex interacts in a sequence-specific way to mediate cleavage in a catalytic fashion. Small interfering RNAs can be synthesized and used. Small interfering RNAs for use in the methods herein suitably comprise between about 1 to about 50 nucleotides (nt). In examples of non-limiting embodiments, siRNAs can comprise about 5 to about 40 nt, about 5 to about 30 nt, about 10 to about 30 nt, about 15 to about 25 nt, or about 20-25 nucleotides.

In some embodiments, selection of appropriate oligonucleotides is facilitated by using computer programs that automatically align nucleic acid sequences and indicate regions of identity or homology. Such programs are used to compare nucleic acid sequences obtained, for example, by searching databases such as GenBank or by sequencing PCR products. Comparison of nucleic acid sequences from a range of species allows the selection of nucleic acid sequences that display an appropriate degree of identity between species. In the case of genes that have not been sequenced, Southern blots are performed to allow a determination of the degree of identity between genes in target species and other species. By performing Southern blots at varying degrees of stringency, as is well known in the art, it is possible to obtain an approximate measure of identity. These procedures allow the selection of oligonucleotides that exhibit a high degree of complementarity to target nucleic acid sequences in a subject to be controlled and a lower degree of complementarity to corresponding nucleic acid sequences in other species. One skilled in the art will realize that there is considerable latitude in selecting appropriate regions of genes.

In some embodiments, "enzymatic RNA" is meant an RNA molecule with enzymatic activity. Enzymatic nucleic acids (ribozymes) act by first binding to a target RNA. Such binding occurs through the target binding portion of an enzymatic nucleic acid which is held in close proximity to an enzymatic portion of the molecule that acts to cleave the target RNA. Thus, the enzymatic nucleic acid first recognizes and then binds a target RNA through base pairing, and once bound to the correct site, acts enzymatically to cut the target RNA In some embodiments, "decoy RNA" is meant an RNA molecule that mimics the natural binding domain for a ligand. The decoy RNA therefore competes with natural binding target for the binding of a specific ligand. For example, over-expression of HIV trans-activation response (TAR) RNA can act as a "decoy" and efficiently binds HIV tat protein, thereby preventing it from binding to TAR sequences encoded in the HIV RNA This is meant to be a specific example. Those in the art will recognize that this is but one example, and some embodiments can be readily generated using techniques generally known in the art.

In some embodiments, "monomers" typically indicates monomers linked by phosphodiester bonds or analogs thereof to form oligonucleotides ranging in size from a few monomelic units, e.g., from about 3-4, to about several hundreds of monomelic units. Analogs of phosphodiester linkages include: phosphorothioate, phosphorodithioate, methylphosphomates, phosphoroselenoate, phosphoramidate, and the like, as more fully described below.

In some embodiments, "nucleotide" covers naturally occurring nucleotides as well as non-naturally occurring nucleotides. It should be clear to the person skilled in the art that various nucleotides which previously have been considered "non-naturally occurring" have subsequently been found in nature. Thus, "nucleotides" includes not only the known purine and pyrimidine heterocycles-containing molecules, but also heterocyclic analogues and tautomers thereof. Illustrative examples of other types of nucleotides are molecules containing adenine, guanine, thymine, cytosine, uracil, purine, xanthine, ˆaminopurine, 8-oxo-N6-memyladenine, 7-deazaxanthine, 7-deazaguanine, N4,N4-ethanocytosin, N6,N6-ethano-2,6-diaminopurine, 5-methylcytosine, 5-(C3-C6)-alkynylcytosine, 5-fluorouracil, 5-bromouracil, pseudoisocytosine, 2-hydroxy-5-memyl-4-triazolopvridin, isocytosine, isoguanin, inosine and the "non-naturally occurring" nucleotides described in Benner et al, U.S. Pat. No. 5,432,272. The term "nucleotide" is intended to cover every and all of these examples as well as analogues and tautomers thereof. Especially interesting nucleotides are those containing adenine, guanine, thymine, cytosine, and uracil, which are considered as the naturally occurring nucleotides in relation to therapeutic and diagnostic application in humans. Nucleotides include the natural 2'-deoxy and 2'-hydroxyl sugars, as well as their analogs.

In some embodiments, "analogs" in reference to nucleotides includes synthetic nucleotides having modified base moieties and/or modified sugar moieties. Such analogs include synthetic nucleotides designed to enhance binding properties, e.g., duplex or triplex stability, specificity, or the like.

In some embodiments, "hybridization" means the pairing of at least substantially complementary strands of oligomeric compounds. One mechanism of pairing involves hydrogen bonding, which may be Watson-Crick, Hoogsteen or reversed Hoogsteen hydrogen bonding, between complementary nucleoside or nucleotide bases (nucleotides) of the strands of oligomeric compounds. For example, adenine and thymine are complementary nucleotides which pair through the formation of hydrogen bonds. Hybridization can occur under varying circumstances.

In some embodiments, an antisense compound is "specifically hybridizable" when binding of the compound to the target nucleic acid interferes with the normal function of the target nucleic acid to cause a modulation of function and/or activity, and there is a sufficient degree of complementarity to avoid non-specific binding of the antisense compound to non-target nucleic acid sequences under conditions in which specific binding is desired, i.e., under physiological conditions in the case of in vivo assays or therapeutic treatment, and under conditions in which assays are performed in the case of in vitro assays.

In some embodiments, "stringent hybridization conditions" or "stringent conditions" refers to conditions under which a compound will hybridize to its target sequence, but to a minimal number of other sequences. Stringent conditions are sequence-dependent and will be different in different circumstances and "stringent conditions" under which oligomeric compounds hybridize to a target sequence are determined by the nature and composition of the oligomeric compounds and the assays in which they are being investigated. In some cases, stringent hybridization conditions comprise low concentrations (<0.15M) of salts with inorganic cations such as Na+ or K+ (i.e., low ionic strength), temperature higher than about 20° C. to 25° C. and below the Tm of the oligomeric compound/target sequence complex, and the presence of denaturants such as formamide, dimethylformamide, dimethyl sulfoxide, or the detergent sodium dodecyl sulfate (SDS). For example, the hybridization rate decreases 1.1% for each 1% formamide. An example of a high stringency hybridization condition is 0.1× sodium chloride-sodium citrate buffer (SSC)/0.1% (w/v) SDS at 60° C. for 30 minutes.

In some embodiments, "complementary" refers to the capacity for precise pairing between two nucleotides on one or two oligomeric strands. For example, if a nucleobase at a certain position of an antisense compound is capable of hydrogen bonding with a nucleobase at a certain position of a target nucleic acid, said target nucleic acid being a DNA, RNA, or oligonucleotide molecule, then the position of hydrogen bonding between the oligonucleotide and the target nucleic acid may be considered to be a complementary position. The oligomeric compound and the further DNA, RNA, or oligonucleotide molecule are complementary to each other when a sufficient number of complementary positions in each molecule are occupied by nucleotides which can hydrogen bond with each other. Thus, "specifically hybridizable" and "complementary" are terms which may be used to indicate a sufficient degree of precise pairing or complementarity over a sufficient number of nucleotides such that stable and specific binding occurs between the oligomeric compound and a target nucleic acid.

The sequence of an oligomeric compound need not be 100% complementary to that of its target nucleic acid to be specifically hybridizable. Moreover, an oligonucleotide may hybridize over one or more segments such that intervening or adjacent segments are not involved in the hybridization event (e.g., a loop structure, mismatch or hairpin structure). In some embodiments, oligomeric compounds disclosed herein comprise at least about 70%, or at least about 75%, or at least about 80%, or at least about 85%, or at least about 90%, or at least about 95%, or at least about 99% sequence complementarity to a target region within the target nucleic acid sequence to which they are targeted. For example, an antisense compound in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. As such, an antisense compound which is 18 nucleotides in length having 4 (four) noncomplementary nucleotides which are flanked by two regions of complete complementarity with the target nucleic acid would have 77.8% overall complementarity with the target nucleic acid and would thus fall within the scope of the present disclosure. Percent complementarity of an antisense compound with a region of a target nucleic acid can be determined routinely using BLAST programs (basic local alignment search tools) and PowerBLAST programs known in the art. Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman.

In some embodiments, the term "Thermal Melting Point (Tm)" refers to the temperature, under defined ionic strength, pH and nucleic acid concentration, at which 50% of the oligonucleotides complementary to the target sequence hybridize to the target sequence at equilibrium. Typically, stringent conditions will be those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions may also be achieved with the addition of destabilizing agents such as formamide.

In some embodiments, "modulation" means either an increase (stimulation) or a decrease (inhibition) in the expression of a gene.

In some embodiments, the term "variant", when used in the context of a polynucleotide sequence, may encompass a polynucleotide sequence related to a wild type gene. This definition may also include, for example, "allelic," "splice," "species," or "polymorphic" variants. A splice variant may have significant identity to a reference molecule, but will generally have a greater or lesser number of polynucleotides due to alternate splicing of exons during mRNA processing. The corresponding polypeptide may possess additional functional domains or an absence of domains. Species variants are polynucleotide sequences that vary from one species to another. Of particular utility are variants of wild type gene products. Variants may result from at least one mutation in the nucleic acid sequence and may result in altered mRNAs or in polypeptides whose structure or function may or may not be altered. Any given natural or recombinant gene may have none, one, or many allelic forms. Common mutational changes that give rise to variants are generally ascribed to natural deletions, additions, or substitutions of nucleotides. Each of these types of changes may occur alone, or in combination with the others, one or more times in a given sequence.

The resulting polypeptides generally will have significant amino acid identity relative to each other. A polymorphic variant is a variation in the polynucleotide sequence of a particular gene between individuals of a given species. Polymorphic variants also may encompass "single nucleotide polymorphisms" (SNPs,) or single base mutations in which the polynucleotide sequence varies by one base. The presence of SNPs may be indicative of, for example, a certain population with a propensity for a disease state, that is susceptibility versus resistance.

Derivative polynucleotides include nucleic acids subjected to chemical modification, for example, replacement of hydrogen by an alkyl, acyl, or amino group. Derivatives, e.g., derivative oligonucleotides, may comprise non-naturally-occurring portions, such as altered sugar moieties or inter-sugar linkages. Exemplary among these are phosphorothioate and other sulfur containing species which are known in the art. Derivative nucleic acids may also contain labels, including radionucleotides, enzymes, fluorescent agents, chemiluminescent agents, chromogenic agents, substrates, co factors, inhibitors, magnetic particles, and the like.

In some embodiments, a "derivative" polypeptide or peptide is one that is modified, for example, by glycosylation, pegylation, phosphorylation, sulfation, reduction/alkylation, acylation, chemical coupling, or mild formalin treatment. A derivative may also be modified to contain a detectable label, either directly or indirectly, including, but not limited to, a radioisotope, fluorescent, and enzyme label.

As used herein, the term "animal" or "patient" is meant to include, for example, humans, sheep, elks, deer, mule deer, minks, mammals, monkeys, horses, cattle, pigs, goats, dogs, cats, rats, mice, birds, chicken, reptiles, fish, insects and arachnids.

"Mammal" covers warm blooded mammals that are typically under medical care (e.g., humans and domesticated animals). Examples include feline, canine, equine, bovine, and human, as well as just human.

"Treating" or "treatment" includes the treatment of a disease-state in a mammal, and includes: (a) preventing the disease-state from occurring in a mammal, in particular, when such mammal is predisposed to the disease-state but has not yet been diagnosed as having it; (b) inhibiting the disease-state, e.g., arresting it development; and/or (c) relieving the disease-state, e.g., causing regression of the disease state until a desired endpoint is reached. Treating also includes the amelioration of a symptom of a disease (e.g., lessen the pain or discomfort), wherein such amelioration may or may not be directly affecting the disease (e.g., cause, transmission, expression, etc.). The term "treatment" is intended to encompass also prophylaxis, therapy and cure. The patient receiving this treatment is any animal in need, including primates, in particular humans, and other mammals such as equines, cattle, swine and sheep; and poultry and pets in general.

All genes, gene names, and gene products disclosed herein are intended to correspond to homologs from any species for which the compositions and methods disclosed herein are applicable. Thus, the terms include, but are not limited to genes and gene products from humans and mice. It is understood that when a gene or gene product from a particular species is disclosed, this disclosure is intended to be exemplary only, and is not to be interpreted as a limitation unless the context in which it appears clearly indicates. Thus, for example, for the genes disclosed herein, which in some embodiments relate to mammalian nucleic acid and amino acid sequences are intended to encompass homologous and/or orthologous genes and gene products from other animals including, but not limited to other mammals, fish, amphibians, reptiles, and birds. In some embodiments, the genes or nucleic acid sequences are human.

In some embodiments, the term "halo" refers to any radical of fluorine, chlorine, bromine or iodine. In some embodiments, the term "alkyl" refers to saturated and unsaturated non-aromatic hydrocarbon chains that may be a straight chain or branched chain, containing the indicated number of carbon atoms (these include without limitation propyl, allyl, or propargyl), which may be optionally inserted with N, O, or S. For example, Ci-Cio indicates that the group may have from 1 to 10 (inclusive) carbon atoms in it. The term "alkoxy" refers to an —O-alkyl radical. In some embodiments, the term "alkylene" refers to a divalent alkyl (i.e., —R—). The term "alkylenedioxo" refers to a divalent species of the structure-0-R-0-, in which R represents an alkylene. The term "aminoalkyl" refers to an alkyl substituted with an amino. In some embodiments, the term "mercapto" refers to an —SH radical. The term "thioalkoxy" refers to an —S-alkyl radical.

In some embodiments, the term "aryl" refers to a 6-carbon monocyclic or 10-carbon bicyclic aromatic ring system wherein 0, 1, 2, 3, or 4 atoms of each ring may be substituted by a substituent. Examples of aryl groups include phenyl, naphthyl and the like. In some embodiments, the term "arylalkyl" or the term "aralkyl" refers to alkyl substituted with an aryl. In some embodiments, the term "arylalkoxy" refers to an alkoxy substituted with aryl.

In some embodiments, the term "cycloalkyl" as employed herein includes saturated and partially unsaturated cyclic hydrocarbon groups having 3 to 12 carbons, for example, 3 to 8 carbons, and, for example, 3 to 6 carbons, wherein the cycloalkyl group additionally may be optionally substituted. Cycloalkyl groups include, without limitation, cyclopropyl, cyclobutyl, cyclopentyl, cyclopentenyl, cyclohexyl, cyclohexenyl, cycloheptyl, and cyclooctyl.

In some embodiments, the term "heteroaryl" refers to an aromatic 5-8 membered monocyclic, 8-12 membered bicyclic, or 1 1-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9heteroatoms of N, O, or S if monocyclic, bicyclic, or tricyclic, respectively), wherein 0, 1, 2, 3, or 4 atoms of each ring may be substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like. In some embodiments, the term "heteroarylalkyl" or the term "heteroaralkyl" refers to an alkyl substituted with a heteroaryl. In some embodiments, the term "heteroarylalkoxy" refers to an alkoxy substituted with heteroaryl.

In some embodiments, the term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9heteroatoms of N, O, or S if monocyclic, bicyclic, or tricyclic, respectively), wherein 0, 1, 2 or 3 atoms of each ring may be substituted by a substituent. Examples of heterocyclyl groups include trizolyl, tetrazolyl, piperazinyl, pyrrolidinyl, dioxanyl, morpholinyl, tetrahydrofuranyl, and the like.

In some embodiments, the term "oxo" refers to an oxygen atom, which forms a carbonyl when attached to carbon, an N-oxide when attached to nitrogen, and a sulfoxide or sulfone when attached to sulfur.

In some embodiments, the term "acyl" refers to an alkylcarbonyl, cycloalkylcarbonyl, arylcarbonyl, heterocyclylcarbonyl, or heteroarylcarbonyl substituent, any of which may be further substituted by substituents.

In some embodiments, the term "substituted" refers to the replacement of one or more hydrogen radicals in a given structure with the radical of a specified substituent including, but not limited to: halo, alkyl, alkenyl, alkynyl, aryl, heterocyclyl, thiol, alkylthio, arylthio, alkylthioalkyl, arylthioalkyl, alkylsulfonyl, alkylsulfonylalkyl, arylsulfonylalkyl, alkoxy, aryloxy, aralkoxy, aminocarbonyl, alkylamino carbonyl, arylaminocarbonyl, alkoxycarbonyl, aryloxycarbonyl, haloalkyl, amino, trifluoromethyl, cyano, nitro, alkylamino, arylamino, alkylaminoalkyl, arylaminoalkyl, aminoalkylamino, hydroxy, alkoxyalkyl, carboxyalkyl, alkoxycarbonylalkyl, aminocarbonylalkyl, acyl, aralkoxycarbonyl, carboxylic acid, sulfonic acid, sulfonyl, phosphonic acid, aryl, heteroaryl, heterocyclic, and aliphatic. It is understood that the substituent can be further substituted.

Oligonucleotide Compounds and Compositions

Some embodiments refer to nucleic acid sequence information. In some embodiments, any uracil (U) may be interchanged with any thymine (T), and vice versa. For example, in an siRNA with a nucleic acid sequence comprising one or more Us. In some embodiments any of the Us may be replaced with Ts. Similarly, in an siRNA with a nucleic acid sequence comprising one or more Ts, in some embodiments any of the Ts may be replaced with Us. In some embodiments, an oligonucleotide such as an siRNA disclosed herein comprises or consists of RNA. In some embodiments, the oligonucleotide may comprise or consist of DNA Some embodiments refer to a particular nucleic acid sequence comprising modified nucleic acids. In some embodiments, an oligonucleotide described herein comprises or consists of a nucleic acid sequence comprising an unmodified version of the nucleic acid sequence comprising modified nucleic acids. In some embodiments, an oligonucleotide described herein comprises or consists of a nucleic acid sequence comprising the nucleic acid sequence comprising modified nucleic acids, but with any one or more additional modifications or different modifications.

In some embodiments, provided herein are oligonucleotide compounds that target a nucleic acid sequence of angiopoietin like 7 (ANGPTL7), including, without limitation, sense and/or antisense noncoding and/or coding sequences associated with ANGPTL7. In some embodiments, the target nucleic acid molecule is not limited to ANGPTL7 polynucleotides alone but extends to any of the isoforms, receptors, homologs, non-coding regions and the like of ANGPTL7.

In some embodiments, provided is a composition comprising one or more antisense oligonucleotides or dsRNA agents targeted to a first nucleic acid and one or more additional antisense compounds targeted to a second nucleic acid target. For example, the first target may be a particular sequence of angiopoietin like 7 (ANGPTL7), and the second target may be a region from another nucleotide sequence. In some embodiments, compositions may contain two or more antisense oligonucleotide or dsRNA compounds targeted to different regions of the same ANGPTL7 nucleic acid target. Numerous examples of antisense oligonucleotide or dsRNA compounds are illustrated herein and others may be selected from among suitable compounds known in the art. Two or more combined compounds may be used together or sequentially.

In some embodiments, a composition is provided that includes a plurality of antisense oligonucleotide or dsRNA agent species. In some embodiments, the antisense oligonucleotide or dsRNA agent species has sequences that are non-overlapping and non-adjacent to another species with respect to a naturally occurring target sequence. In some embodiments, the plurality of antisense oligonucleotide or dsRNA agent species is specific for different naturally occurring target genes. In some embodiments, the dsRNA agent is allele specific.

The disclosure provides methods, compositions, and kits, for administration and delivery of antisense oligonucleotide or dsRNA agents described herein.

Compositions

Disclosed herein, in some embodiments, are compositions comprising an oligonucleotide. In some embodiments, the composition comprises an oligonucleotide that targets ANGPTL7. In some embodiments, the composition consists of an oligonucleotide that targets ANGPTL7. In some embodiments, a composition described herein is used in a method of treating a disorder in a subject in need thereof. Some embodiments relate to a composition comprising an oligonucleotide for use in a method of treating a disorder as described herein. Some embodiments relate to use of a composition comprising an oligonucleotide, in a method of treating a disorder as described herein. The composition (e.g. oligonucleotide composition) may comprise or consist of a dsRNA agent described herein. The composition (e.g. oligonucleotide composition) may comprise or consist of an siRNA described herein. The composition (e.g. oligonucleotide composition) may comprise or consist of an antisense oligonucleotide described herein.

In some embodiments, the composition comprises an oligonucleotide that targets ANGPTL7 and when administered to a subject in an effective amount decreases ANGPTL7 mRNA levels in a cell or tissue. In some embodiments, the cell is a ANGPTL7. In some embodiments, the tissue is ANGPTL7 tissue. In some embodiments, the ANGPTL7 mRNA levels are decreased by about 2.5% or more, about 5% or more, or about 7.5% or more, as compared to prior to administration. In some embodiments, the ANGPTL7 mRNA levels are decreased by about 10% or more, as compared to prior to administration. In some embodiments, the ANGPTL7 mRNA levels are decreased by about 20% or more, about 30% or more, about 40% or more, about 50% or more, about 60% or more, about 70% or more, about 80% or more, about 90% or more, or about 100% or more as compared to prior to administration. In some embodiments, the ANGPTL7 mRNA levels are decreased by about 200% or more, about 300% or more, about 400% or more, about 500% or more, about 600% or more, about 700% or more, about 800% or more, about 900% or more, or about 1000% or more, as compared to prior to administration. In some embodiments, the ANGPTL7 mRNA levels are decreased by no more than about 2.5%, no more than about 5%, or no more than about 7.5%, as compared to prior to administration. In some embodiments, the ANGPTL7 mRNA levels are decreased by no more than about 10%, as compared to prior to administration. In some embodiments, the ANGPTL7 mRNA levels are decreased by no more than about 20%, no more than about 30%, no more than about 40%, no more than about 50%, no more than about 60%, no more than about 70%, no more than about 80%, no more than about 90%, or no more than about 100% as compared to prior to administration. In some embodiments, the ANGPTL7 mRNA levels are decreased by no more than about 200%, no more than about 300%, no more than about 400%, no more than about 500%, no more than about 600%, no more than about 700%, no more than about 800%, no more than about 900%, or no more than about 1000%, as compared to prior to administration. In some embodiments, the ANGPTL7 mRNA levels are decreased by 2.5%, 5%, 7.5%, 10%, 20%, 30%, 40%, 50%, 60%, 70% 80% 90% 100% 200% 300% 400% 500% 600% 700% 800% 900% 1000% or by a range defined by any of the two aforementioned percentages.

In some embodiments, the composition comprises an oligonucleotide that targets ANGPTL7 and when administered to a subject in an effective amount decreases circulating ANGPTL7 protein levels. In some embodiments, the ANGPTL7 protein levels are decreased by about 2.5% or more, about 5% or more, or about 7.5% or more, as compared to prior to administration. In some embodiments, the ANGPTL7 protein levels are decreased by about 10% or more, as compared to prior to administration. In some embodiments, the ANGPTL7 protein levels are decreased by about 20% or more, about 30% or more, about 40% or more, about 50% or more, about 60% or more, about 70% or more, about 80% or more, about 90% or more, or about 100% or more as compared to prior to administration. In some embodiments, the ANGPTL7 protein levels are decreased by about 200% or more, about 300% or more, about 400% or more, about 500% or more, about 600% or more, about 700% or more, about 800% or more, about 900% or more, or about 1000% or more, as compared to prior to administration. In some embodiments, the ANGPTL7 protein levels are decreased by no more than about 2.5%, no more than about 5%, or no more than about 7.5%, as compared to prior to administration. In some embodiments, the ANGPTL7 protein levels are decreased by no more than about 10%, as compared to prior to administration. In some embodiments, the ANGPTL7 protein levels are decreased by no more than about 20%, no more than about 30%, no more than about 40%, no more than about 50%, no more than about 60%, no more than about 70%, no more than about 80%, no more than about 90%, or no more than about 100% as compared to prior to administration. In some embodiments, the ANGPTL7 protein levels are decreased by no more than about 200%, no more than about 300%, no more than about 400%, no more than about 500%, no more than about 600%, no more than about 700%, no more than about 800%, no more than about 900%, or no more than about 1000%, as compared to prior to administration. In some embodiments, the ANGPTL7 protein levels are decreased by 2.5%, 5%, 7.5%, 10%, 20%, 30%, 40%, 50%, 60%, 70%, 80%, 90%, 100%, 200% 300%, 400%, 500%, 600%, 700%, 800%, 900%, 1000%, or by a range defined by any of the two aforementioned percentages.

In some embodiments, the composition comprises an oligonucleotide that targets ANGPTL7 and when administered to a subject in an effective amount decreases a symptom of glaucoma. In some embodiments, the glaucoma symptom is decreased by about 2.5% or more, about 5% or more, or about 7.5% or more, as compared to prior to administration. In some embodiments, the glaucoma symptom is decreased by about 10% or more, as compared to prior to administration. In some embodiments, the glaucoma symptom is decreased by about 20% or more, about 30% or more, about 40% or more, about 50% or more, about 60% or more, about 70% or more, about 80% or more, about 90% or more, or about 100% or more as compared to prior to administration. In some embodiments, the glaucoma symptom is decreased by no more than about 2.5%, no more than about 5%, or no more than about 7.5%, as compared to prior to administration. In some embodiments, the glaucoma symptom is decreased by no more than about 10%, as compared to prior to administration. In some embodiments, the glaucoma symptom is decreased by no more than about 20%, no more than about 30%, no more than about 40%, no more than about 50%, no more than about 60%, no more than about 70%, no more than about 80%, no more than about 90%, or no more than about 100% as compared to prior to administration. In some embodiments, the glaucoma symptom is decreased by 2.5%, 5%, 7.5%, 10%, 20%, 30%, 40%, 50%, 60%, 70%, 80%, 90%, or 100%, or by a range defined by any of the two aforementioned percentages. In some embodiments, the glaucoma symptom is incidence of glaucoma, or of a glaucoma subtype. In some embodiments, the glaucoma symptom is severity of glaucoma, or of a glaucoma subtype. Examples of glaucoma subtypes include non-specific glaucoma, primary open angle glaucoma (POAG), and primary angle closure glaucoma (PACG).

In some embodiments, the composition comprises an oligonucleotide that targets ANGPTL7 and when administered to a subject in an effective amount decreases intraocular pressure. In some embodiments, the intraocular pressure is decreased by about 2.5% or more, about 5% or more, or about 7.5% or more, as compared to prior to administration. In some embodiments, the intraocular pressure is decreased by about 10% or more, as compared to prior to administration. In some embodiments, the intraocular pressure is decreased by about 20% or more, about 30% or more, about 40% or more, about 50% or more, about 60% or more, about 70% or more, about 80% or more, about 90% or more, or about 100% or more as compared to prior to administration. In some embodiments, the intraocular pressure is decreased by no more than about 2.5%, no more than about 5%, or no more than about 7.5%, as compared to prior to administration. In some embodiments, the intraocular pressure is decreased by no more than about 10%, as compared to prior to administration. In some embodiments, the intraocular pressure is decreased by no more than about 20%, no more than about 30%, no more than about 40%, no more than about 50%, no more than about 60%, no more than about 70%, no more than about 80%, no more than about 90%, or no more than about 100% as compared to prior to administration. In some embodiments, the intraocular pressure is decreased by 2.5%, 5%, 7.5%, 10%, 20%, 30%, 40%, 50%, 60%, 70%, 80%, 90%, or 100%, or by a range defined by any of the two aforementioned percentages.

Modification Patterns

In some embodiments, the composition comprises an oligonucleotide that inhibits the expression of ANGPTL7, wherein the oligonucleotide comprises a modification comprising a modified nucleoside and/or a modified internucleoside linkage, and/or (ii) the composition comprises a pharmaceutically acceptable carrier. In some embodiments, the oligonucleotide comprises a modification comprising a modified nucleoside and/or a modified internucleoside linkage. In some embodiments, the oligonucleotide comprises a modified internucleoside linkage. In some embodiments, the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof. In some embodiments, the modified internucleoside linkage comprises one or more phosphorothioate linkages. Benefits of the modified internucleoside linkage may include decreased toxicity or improved pharmacokinetics. The composition (e.g. oligonucleotide composition) may comprise or consist of a dsRNA agent described herein. The composition (e.g. oligonucleotide composition) may comprise or consist of an siRNA described herein. The composition (e.g. oligonucleotide composition) may comprise or consist of an antisense oligonucleotide described herein.

In some embodiments, the composition comprises an oligonucleotide that inhibits the expression of ANGPTL7, wherein the oligonucleotide comprises a modified internucleoside linkage, wherein the oligonucleotide comprises 1, 2, 3, 4, 5, 6, 7, 8, 9, 10, 11, 12, 13, 14, 15, 16, 17, 18, 19, or 20 modified internucleoside linkages, or a range of modified internucleoside linkages defined by any two of the aforementioned numbers. In some embodiments, the oligonucleotide comprises no more than 18 modified internucleoside linkages. In some embodiments, the oligonucleotide comprises no more than 20 modified internucleoside linkages. In some embodiments, the oligonucleotide comprises 2 or more modified internucleoside linkages, 3 or more modified internucleoside linkages, 4 or more modified internucleoside linkages, 5 or more modified internucleoside linkages, 6 or more modified internucleoside linkages, 7 or more modified internucleoside linkages, 8 or more modified internucleoside linkages, 9 or more modified internucleoside linkages, 10 or more modified internucleoside linkages, 11 or more modified internucleoside linkages, 12 or more modified internucleoside linkages, 13 or more modified internucleoside linkages, 14 or more modified internucleoside linkages, 15 or more modified internucleoside linkages, 16 or more modified internucleoside linkages, 17 or more modified internucleoside linkages, 18 or more modified internucleoside linkages, 19 or more modified internucleoside linkages, or 20 or more modified internucleoside linkages.

In some embodiments, the composition comprises an oligonucleotide that inhibits the expression of ANGPTL7, wherein the oligonucleotide comprises the modified nucleoside. In some embodiments, the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-fluoro, or 2'-deoxy, or a combination thereof. In some embodiments, the modified nucleoside comprises a LNA. In some embodiments, the modified nucleoside comprises a 2',4' constrained ethyl nucleic acid. In some embodiments, the modified nucleoside comprises HLA. In some embodiments, the modified nucleoside comprises CeNA. In some embodiments, the modified nucleoside comprises a 2'-methoxyethyl group. In some embodiments, the modified nucleoside comprises a 2'-O-alkyl group. In some embodiments, the modified nucleoside comprises a 2'-O-allyl group. In some embodiments, the modified nucleoside comprises a 2'-fluoro group. In some embodiments, the modified nucleoside comprises a 2'-deoxy group. In some embodiments, the modified nucleoside comprises a 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof. In some embodiments, the modified nucleoside comprises a 2'-O-methyl nucleoside. In some embodiments, the modified nucleoside comprises a 2'-deoxyfluoro nucleoside. In some embodiments, the modified nucleoside comprises a 2'-O-NMA nucleoside. In some embodiments, the modified nucleoside comprises a 2'-O-DMAEOE nucleoside. In some embodiments, the modified nucleoside comprises a 2'-O-aminopropyl (2'-O-AP) nucleoside. In some embodiments, the modified nucleoside comprises 2'-ara-F. In some embodiments, the modified nucleoside comprises one or more 2'fluoro modified nucleosides. In some embodiments, the modified nucleoside comprises a 2' O-alkyl modified nucleoside. Benefits of the modified nucleoside may include decreased toxicity or improved pharmacokinetics.

In some embodiments, the oligonucleotide comprises 1, 2, 3, 4, 5, 6, 7, 8, 9, 10, 11, 12, 13, 14, 15, 16, 17, 18, 19, 20, or 21 modified nucleosides, or a range of nucleosides defined by any two of the aforementioned numbers. In some embodiments, the oligonucleotide comprises no more than 19 modified nucleosides. In some embodiments, the oligonucleotide comprises no more than 21 modified nucleosides. In some embodiments, the oligonucleotide comprises 2 or more modified nucleosides, 3 or more modified nucleosides, 4 or more modified nucleosides, 5 or more modified nucleosides, 6 or more modified nucleosides, 7 or more modified nucleosides, 8 or more modified nucleosides, 9 or more modified nucleosides, 10 or more modified nucleosides, 11 or more modified nucleosides, 12 or more modified nucleosides, 13 or more modified nucleosides, 14 or more modified nucleosides, 15 or more modified nucleosides, 16 or more modified nucleosides, 17 or more modified nucleosides, 18 or more modified nucleosides, 19 or more modified nucleosides, 20 or more modified nucleosides, or 21 or more modified nucleosides.

In some embodiments, a hydrophobic moiety is attached to the oligonucleotide (e.g. a sense strand and/or an antisense strand of an siRNA, or an ASO). In some embodiments, a hydrophobic moiety is attached at a 3' terminus of the oligonucleotide. In some embodiments, a hydrophobic moiety is attached at a 5' terminus of the oligonucleotide. In some embodiments, the hydrophobic moiety comprises cholesterol.

In some embodiments, the composition comprises an oligonucleotide that inhibits the expression of ANGPTL7, wherein the oligonucleotide comprises a lipid attached at a 3' or 5' terminus of the oligonucleotide. In some embodiments, a lipid is attached at a 3' terminus of the oligonucleotide. In some embodiments, a lipid is attached at a 5' terminus of the oligonucleotide. In some embodiments, the lipid comprises cholesterol, myristoyl, palmitoyl, stearoyl, lithocholoyl, docosanoyl, docosahexaenoyl, myristyl, palmityl stearyl, or α-tocopherol, or a combination thereof. In some embodiments, the lipid comprises cholesterol.

In some embodiments, the composition comprises an arginine-glycine-aspartic acid (RGD) peptide. In some embodiments, the RGD peptide is attached at a 3' terminus of the oligonucleotide. In some embodiments, the RGD peptide is attached at a 5' terminus of the oligonucleotide. In some embodiments, the composition comprises a sense strand, and the RGD peptide is attached to the sense strand (e.g. attached to a 5' end of the sense strand, or attached to a 3' end of the sense strand). In some embodiments, the composition comprises an antisense strand, and the RGD peptide is attached to the antisense strand (e.g. attached to a 5' end of the antisense strand, or attached to a 3' end of the antisense strand). In some embodiments, the composition comprises an RGD peptide attached at a 3' or 5' terminus of the oligonucleotide. In some embodiments, the oligonucleotide comprises an RGD peptide and a lipid attached at a 3' or 5' terminus of the oligonucleotide. In some embodiments, the RGD peptide comprises Cyclo(-Arg-Gly-Asp-D-Phe-Cys). In some embodiments, the RGD peptide comprises Cyclo(-Arg-Gly-Asp-D-Phe-Lys). In some embodiments, the RGD peptide comprises Cyclo(-Arg-Gly-Asp-D-Phe-azido). In some embodiments, the RGD peptide comprises an amino benzoic acid derived RGD. In some embodiments, the RGD peptide comprises Cyclo(-Arg-Gly-Asp-D-Phe-Cys), Cyclo(-Arg-Gly-Asp-D-Phe-Lys), Cyclo(-Arg-Gly-Asp-D-Phe-azido), an amino benzoic acid derived RGD, or a combination thereof. In some embodiments, the RGD peptide comprises multiple of such RGD peptides. For example, the RGD peptide may include 2, 3, or 4 RGD peptides.

In some embodiments, the oligonucleotide comprises a dsRNA agent described herein. In some embodiments, the oligonucleotide comprises an siRNA described herein. In some embodiments, the oligonucleotide comprises an antisense oligonucleotide described herein. In some embodiments, one or more nucleotides in the sense and/or antisense strand of an antisense oligonucleotide, dsRNA agent, or siRNA, is modified in accordance with any of the modifications or modification patterns described herein.

In some embodiments, a modification or modification pattern disclosed herein includes a cholesterol moiety.

dsRNA Agent

In some embodiments, the composition comprises a double-stranded RNAi (dsRNA) agent. In one aspect, provided herein is a dsRNA agent capable of inhibiting the expression of ANGPTL7. The dsRNA agent comprises a sense strand and an antisense strand. In some cases, the sense strand comprises a sequence at least about 80%, 85%, 90%, 95%, or 100% identical to a sequence selected from SEQ ID NOS: 1-4412. In some cases, the antisense strand comprises a sequence at least about 80%, 85%, 90%, 95%, or 100% identical to the reverse complement of the sense strand. In some cases, the antisense strand comprises a sequence at least about 80%, 85%, 90%, 95%, or 100% identical to a sequence selected from SEQ ID NOS: 1-4412.

In some cases, each strand of the dsRNA agent can range from 12-30 nucleotides in length. For example, each strand can be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex dsRNA. The duplex region of a dsRNA agent may be 12-30 nucleotide pairs in length. For example, the duplex region can be between 14-30 nucleotide pairs in length, 17-30 nucleotide pairs in length, 25-30 nucleotides in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region has a length of about 15, 16, 17, 18, 19, 20, 21, 22, 23, 24, 25, 26, and 27.

In some embodiments, the dsRNA agent comprises one or more overhang regions and/or capping groups at the 3'-end, or 5'-end, or both ends of a strand. In some cases, the overhang is about 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhang can be the result of one strand being longer than the other, or the result of two strands of the same length being staggered. The overhang can form a mismatch with the target mRNA or it can be complementary to the gene sequences being targeted or can be other sequence. The first and second strands can also be joined, e.g., by additional bases to form a hairpin, or by other non-base linkers.

Described herein, in some embodiments, are compositions comprising an RNA interference (RNAi) agent. In some embodiments, the RNAi agent is capable of inhibiting or modulating the expression of angiopoietin like 7 (ANGPTL7). In some embodiments, the RNAi agent comprises a siRNA described herein. In some embodiments, the RNAi agent comprises a double-stranded RNA (dsRNA). In some embodiments, the dsRNA comprises a sense strand and an antisense strand (such as a sense strand and/or an antisense strand described herein) In some embodiments, the antisense strand is complementary to a portion of a nucleic acid having the nucleoside sequence of SEQ ID NO: 11085. In some embodiments, the antisense strand is complementary to a portion of a nucleic acid having the nucleoside sequence of SEQ ID NO: 11086. In some embodiments, each strand has 14 to 30 nucleotides.

Described herein, in some embodiments, are compositions comprising an RNA interference (RNAi) agent capable of inhibiting or modulating the expression of angiopoietin like 7 (ANGPTL7); wherein the RNAi agent comprises a double-stranded RNA (dsRNA) comprising a sense strand and an antisense strand, the antisense strand being complementary to a portion of a nucleic acid having the nucleoside sequence of SEQ ID NO: 11085, and each strand having 14 to 30 nucleotides.

Described herein, in some embodiments, are compositions comprising an RNA interference (RNAi) agent capable of inhibiting or modulating the expression of angiopoietin like 7 (ANGPTL7); wherein the RNAi agent comprises a double-stranded RNA (dsRNA) comprising a sense strand and an antisense strand, the antisense strand being complementary to a portion of a nucleic acid having the nucleoside sequence of SEQ ID NO: 11086, and each strand having 14 to 30 nucleotides.

In some embodiments, the one or more modifications confers nuclease resistance upon the oligonucleotide (e.g. siRNA or antisense oligonucleotide). In some embodiments, the modification pattern confers nuclease resistance upon the oligonucleotide (e.g. siRNA or antisense oligonucleotide). For example, modification pattern 1S, 2S, 3S, 4S, 5S, 1AS, 2AS, 3AS, 4AS, or ASO1 may confer nuclease resistance.

dsRNA Modifications

The modifications described herein in reference to dsRNA agents may be applicable to antisense oligonucleotides described elsewhere herein. The modifications described herein in reference to dsRNA agents may be applicable to siRNA oligonucleotides described elsewhere herein.

In some embodiments, one or more nucleotides in the sense and/or antisense strand of a dsRNA agent is modified. In some cases, every nucleotide in the sense strand and antisense strand of the dsRNA is modified. The modifications on sense strand and antisense strand may each independently comprises at least two different modifications. In some cases, not every nucleotide in the sense and antisense strand is modified. In some cases, no nucleotide in the sense and/or antisense strand is modified.

In some cases, the sense strand contains at least one motif of three identical modifications on three consecutive nucleotides, where at least one of the motifs occurs at or near the cleavage site in the antisense strand. In some cases, the antisense strand contains at least one motif of three identical modifications on three consecutive nucleotides. The modification pattern of the antisense strand may be shifted by one or more nucleotides relative to the modification pattern of the sense strand.

In some cases, the sense strand contains at least two motifs of three identical modifications on three consecutive nucleotides, when at least one of the motifs occurs at the cleavage site in the strand and at least one of the motifs occurs at another portion of the strand that is separated from the motif at the cleavage site by at least one nucleotide. In some cases, the antisense strand contains at least one motif of three identical modifications on three consecutive nucleotides, where at least one of the motifs occurs at or near the cleavage site in the strand and at least one of the motifs occurs at another portion of the strand that is separated from the motif at or near cleavage site by at least one nucleotide.

In some cases, the sense strand contains at least two motifs of three identical modifications on three consecutive nucleotides, where at least one of the motifs occurs at the cleavage site in the strand and at least one of the motifs occurs at another portion of the strand that is separated from the motif at the cleavage site by at least one nucleotide. In some cases, the antisense strand contains at least one motif of three identical modifications on three consecutive nucleotides, where at least one of the motifs occurs at or near the cleavage site in the strand and at least one of the motifs occurs at another portion of the strand that is separated from the motif at or near cleavage site by at least one nucleotide. In some cases, the modification in the motif occurring at the cleavage site in the sense strand is different than the modification in the motif occurring at or near the cleavage site in the antisense strand.

In some cases, the sense strand contains at least one motif of three 2'-F modifications on three consecutive nucleotides, where at least one of the motifs occurs at the cleavage site in the strand. In some cases, the antisense strand contains at least one motif of three 2'-0-methyl modifications on three consecutive nucleotides.

In some cases, the sense strand comprises one or more motifs of three identical modifications on three consecutive nucleotides, where the one or more additional motifs occur at another portion of the strand that is separated from the three 2'-F modifications at the cleavage site by at least one nucleotide. The antisense strand may comprise one or more motifs of three identical modifications on three consecutive nucleotides, where the one or more additional motifs occur at another portion of the strand that is separated from the three 2'-0-methyl modifications by at least one nucleotide. In some cases at least one of the nucleotides having a 2'-F modification may form a base pair with one of the nucleotides having a 2'-0-methyl modification.

In some embodiments, if the dsRNA agent comprises an overhang, the nucleotides in the overhang region of the dsRNA agent can each independently be a modified or unmodified nucleotide. Non-limiting examples of modifications include, but are not limited to, a 2'-sugar modification, such as, 2-F 2'-Omethyl, thymidine (T), 2'-0-methoxyethyl-5-methyluridine (Teo), 2'-0-methoxyethyladenosine (Aeo), 2'-0-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be other sequence.

In some embodiments, if the dsRNA agent comprises an overhang, the 5'- and/or 3'-overhang at the sense strand, antisense strand or both strands of the dsRNA agent may be phosphorylated. In some embodiments, the overhang region contains two nucleotides having a phosphorothioate between the two nucleotides, where the two nucleotides can be the same or different. In some embodiments, the overhang is present at the 3'-end of the sense strand, antisense strand or both strands. In some embodiments, this 3'-overhang is present in the antisense strand. In some embodiments, this 3'-overhang is present in the sense strand.

In some embodiments, the modified dsRNA agent comprises one or more modified nucleotides including, but not limited to, 2'OMe nucleotides, 2'-deoxy-2'-fluoro (2'F) nucleotides, 2'-deoxy nucleotides, 2'-O-(2-methoxyethyl) (MOE) nucleotides, locked nucleic acid (LNA) nucleotides, or combinations thereof. In some embodiments, the modified dsRNA agent comprises 2'OMe nucleotides (e.g., 2'OMe purine and/or pyrimidine nucleotides) such as, for example, 2'OMe-guanosine nucleotides, 2'OMe-uridine nucleotides, 2'OMe-adenosine nucleotides, 2'OMe-cytosine nucleotides, or combinations thereof. In certain instances, the modified dsRNA agent does not comprise 2'OMe-cytosine nucleotides. In some embodiments, the modified dsRNA agent comprises a hairpin loop structure.

In certain aspects, the modified dsRNA agent has an IC50 less than or equal to ten-fold that of the corresponding unmodified dsRNA (e.g., the modified dsRNA agent has an IC50 that is less than or equal to ten-times the IC50 of the corresponding unmodified dsRNA agent). In some embodiments, the modified dsRNA agent has an IC50 less than or equal to three-fold that of the corresponding unmodified dsRNA agent. In some embodiments, the modified dsRNA agent has an IC50 less than or equal to two-fold that of the corresponding unmodified dsRNA agent. It will be readily apparent to those of skill in the art that a dose response curve can be generated and the IC50 values for the modified dsRNA agent and the corresponding unmodified dsRNA agent can be readily determined using methods known to those of skill in the art.

The modified dsRNA agent may have 3' overhangs of one, two, three, four, or more nucleotides on one or both sides of the double-stranded region, or may lack overhangs (i.e., have blunt ends). In some cases, the modified dsRNA agent has 3' overhangs of two nucleotides on each side of the double-stranded region. In certain instances, the 3' overhang on the antisense strand has complementarity to the target sequence and the 3' overhang on the sense strand has complementarity to the complementary strand of the target sequence. In some cases, the 3' overhangs do not have complementarity to the target sequence or the complementary strand thereof. In some embodiments, the 3' overhangs comprise one, two, three, four, or more nucleotides such as 2'-deoxy(2'H) nucleotides. In some cases, the 3' overhangs comprise deoxythymidine (dT) nucleotides.

In some embodiments, the modified dsRNA agent comprises from about 1% to about 100% (e.g., about 1%, 5%, 10%, 15%, 20%, 25%, 30%, 35%, 40%, 45%, 50%, 55%, 60%, 65%, 70%, 75%, 80%, 85%, 90%, 95%, or 100%) modified nucleotides in the double-stranded region of the dsRNA agent. In some embodiments, less than about 30% (e.g., less than about 30%, 25%, 20%, 15%, 10%, or 5%) or from about 1% to about 30% (e.g., from about 1%-30%, 5%-30%, 10%-30%, 15%-30%, 20%-30%, or 25%-30%) of the nucleotides in the double-stranded region of the dsRNA agent comprise modified nucleotides.

In some embodiments, the dsRNA agent does not comprise phosphate backbone modifications, e.g., in the sense and/or antisense strand of the double-stranded region. In some embodiments, the modified dsRNA agent does not comprise 2'-deoxy nucleotides, e.g., in the sense and/or antisense strand of the double-stranded region. In certain instances, the nucleotide at the 3'-end of the double-stranded region in the sense and/or antisense strand is not a modified nucleotide. In certain instances, the nucleotides near the 3'-end (e.g., within one, two, three, or four nucleotides of the 3'-end) of the double-stranded region in the sense and/or antisense strand are not modified nucleotides.

The dsRNA agent may have 3' overhangs of one, two, three, four, or more nucleotides on one or both sides of the double-stranded region, or may lack overhangs (i.e., have blunt ends). In some cases, the dsRNA agent has 3' overhangs of two nucleotides on each side of the double-stranded region. In some embodiments, the 3' overhangs comprise one, two, three, four, or more nucleotides such as 2'-deoxy (2'H) nucleotides. In some cases, the 3' overhangs comprise deoxythymidine (dT) nucleotides.

The dsRNA agent may also have a blunt end, located at the 5'-end of the antisense strand (or the 3'-end of the sense strand) or vice versa. In some cases, the antisense strand of the dsRNA has a nucleotide overhang at the 3'-end, and the 5'-end is blunt. While not bound by theory, the asymmetric blunt end at the 5'-end of the antisense strand and 3'-end overhang of the antisense strand may favor the guide strand loading into RISC process.

In some embodiments, the dsRNA agent may also have two blunt ends, at both ends of the dsRNA duplex.

In some embodiments, every nucleotide in the sense strand and antisense strand of the dsRNA agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone. In some embodiments, fewer than all nucleotides in the sense and antisense strand are modified.

As nucleic acids are polymers of subunits, in some cases, many of the modifications occur at a position which is repeated within a nucleic acid, e.g., a modification of a base, or a phosphate moiety, or anon-linking O of a phosphate moiety. In some cases the modification will occur at all of the subject positions in the nucleic acid but in other cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a R A or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, purine nucleotides may be included in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-0-methyl modified instead of the ribosugar of the nucleobase, and modifications in the phosphate group, e.g., phosphorothioate modifications. In some cases, overhangs need not be homologous with the target sequence.

In some embodiments, each residue of the sense strand and antisense strand is independently modified with LNA, HNA, CeNA, 2'-methoxyethyl, 2'-O-methyl, 2'-0-allyl, 2'-C-allyl, 2'-deoxy, or 2'-fluoro. The strands can contain more than one modification. In some embodiments, each residue of the sense strand and antisense strand is independently modified with 2' O-methyl or 2'-fluoro.

In some embodiments, at least two different modifications are present on the sense strand and antisense strand. Those two modifications may be the 2'-O-methyl or 2'-fluoro modifications, or others.

In some embodiments, the sense strand and antisense strand each contains two differently modified nucleotides selected from 2'-0-methyl or 2'-fluoro.

In some embodiments, each residue of the sense strand and antisense strand is independently modified with 2'-0-methyl nucleotide, 2'-deoxyfluoro nucleotide, 2-0-N-methylacetamido (2'-0-NMA) nucleotide, a 2'-0-dimethylaminoethoxyethyl (2'-0-DMAEOE) nucleotide, 2'-0-aminopropyl (2'-0-AP) nucleotide, or 2'-ara-F nucleotide.

The type of modifications contained in an alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "AC AC AC . . . " "BDBDBD . . . " or "CDCDCD . . . ," etc.

In some embodiments, the dsRNA agent comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5 of the strand within the duplex region. As another example, the alternating motif in the sense strand may start with "AABBAABB" from 5'-3' of the strand and the alternating motif in the antisense strand may start with "BBAABBAA" from 3'-5 Of the strand within the duplex region, so that there is a complete or partial shift of the modification patterns between the sense strand and the antisense strand.

In some embodiments, the dsRNA agent comprises the pattern of the alternating motif of 2'-0-methyl modification and 2'-F modification on the sense strand initially has a shift relative to the pattern of the alternating motif of 2'-0-methyl modification and 2'-F modification on the antisense strand initially, i.e., the 2'-0-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification. The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand may enhance the gene silencing activity to the target gene.

The dsRNA agent may comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand and/or antisense strand, each internucleotide linkage modification may occur in an alternating pattern on the sense strand or antisense strand, or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. In some cases, these terminal three nucleotides may be at the 3'-end of the antisense strand.

In some embodiments the sense strand of the dsRNA agent comprises 1-10 blocks of two to ten phosphorothioate or methylphosphonate internucleotide linkages separated by about 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of two phosphorothioate or methylphosphonate internucleotide linkages separated by about 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of three phosphorothioate or methylphosphonate internucleotide linkages separated by about 1, 2, 3, 4, 5, 6, 7, 8, 9, 10, 11, 12, 13, 14, 15 or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of four phosphorothioate or methylphosphonate internucleotide linkages separated by about 1, 2, 3, 4, 5, 6, 7, 8, 9, 10, 11, 12, 13 or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of five phosphorothioate or methylphosphonate internucleotide linkages separated by about 1, 2, 3, 4, 5, 6, 7, 8, 9, 10, 11 or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of six phosphorothioate or methylphosphonate internucleotide linkages separated by about 1, 2, 3, 4, 5, 6, 7, 8, 9 or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of seven phosphorothioate or methylphosphonate internucleotide linkages separated by about 1, 2, 3, 4, 5, 6, 7 or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of eight phosphorothioate or methylphosphonate internucleotide linkages separated by about 1, 2, 3, 4, 5 or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments the antisense strand of the dsRNA agent comprises two blocks of nine phosphorothioate or methylphosphonate internucleotide linkages separated by about 1, 2, 3 or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphophonate or phosphate linkage.

In some embodiments, the dsRNA agent comprises one or more phosphorothioate or methylphosphonate internucleotide linkage modification within 1-10 of the termini position(s) of the sense and/or antisense strand. For example, at least about 2, 3, 4, 5, 6, 7, 8, 9 or 10 nucleotides may be linked through phosphorothioate or methylphosphonate internucleotide linkage at one end or both ends of the sense and/or antisense strand.

In some embodiments, the dsRNA agent comprises one or more phosphorothioate or methylphosphonate internucleotide linkage modification within 1-10 of the internal region of the duplex of each of the sense and/or antisense strand. For example, at least about 2, 3, 4, 5, 6, 7, 8, 9 or 10 nucleotides may be linked through phosphorothioate methylphosphonate internucleotide linkage at position 8-16 of the duplex region counting from the 5'-end of the sense strand; the dsRNA can optionally further comprise one or more phosphorothioate or methylphosphonate internucleotide linkage modification within 1-10 of the termini position(s).

In some embodiments, the dsRNA agent comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA agent comprises one phosphorothioate internucleotide linkage modification within position 1-5 and one phosphorothioate or methylphosphonate internucleotide linkage modification within position 18-23 of the sense strand (counting from the 5' end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA agent comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end). In some embodiments, the dsRNA agent comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA agent comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA agent comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA agent comprises one phosphorothioate internucleotide linkage modification within position 1-5 (counting from the 5'-end), and two phosphorothioateinternucleotide linkage modifications at positions 1 and 2 and one phosphorothioate internucleotide linkage modification within positions 18-23 of the antisense strand (counting from the 5'-end).

In some embodiments, the dsRNA agent comprises two phosphorothioate internucleotide linkage modifications within position 1-5 (counting from the 5'-end), and one phosphorothioateinternucleotide linkage modification at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA agent comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA agent comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA agent comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA agent comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA agent comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA agent comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA agent comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, the dsRNA agent comprises mismatch(es) with the target, within the duplex, or combinations thereof. The mismatch can occur in an overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In some cases, in terms of promoting dissociation: AU is preferred over G:C; G:U is preferred over G:C; and I:C is preferred over G:C (I=inosine). In some cases, mismatches, e.g., non-canonical or other than canonical pairings (as described elsewhere herein) are preferred over canonical (AT, AU, G:C) pairings; and pairings which include a universal base are preferred over canonical pairings. In some embodiments, the dsRNA agent comprises at least one of the first 1, 2, 3, 4, or 5 base pairs within the duplex regions from the 5'-end of the antisense strand can be chosen independently from the group of: AU, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. In some embodiments, at least one of the first 1, 2 or 3 base pair within the duplex region from the 5'-end of the antisense strand is an AU base pair. For example, the first base pair within the duplex region from the 5'-end of the antisense strand is an AU base pair.

In some embodiments, the dsRNA agent is conjugated to one or more carbohydrate moieties, which may optimize one or more properties of the dsRNA agent. In some cases, the carbohydrate moiety is attached to a modified subunit of the dsRNA agent. For example, the ribose sugar of one or more ribonucleotide subunits of a dsRNA agent can be replaced with another moiety, e.g., anon-carbohydrate (e.g., cyclic) carrier to which is attached a carbohydrate ligand. A ribonucleotide subunit in which the ribose sugar of the subunit is so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

In some embodiments, a ligand is attached to the dsRNA via a carrier. In some cases, the carriers include (i) at least one "backbone attachment point" or two "backbone attachment points" and (ii) at least one "tethering attachment point." In some cases, a "backbone attachment point" refers to a functional group, e.g. a hydroxy 1 group, or generally, a bond available for, and that is suitable for incorporation of the carrier into the backbone, e.g., the phosphate, or modified phosphate, e.g., sulfur containing, backbone, of a ribonucleic acid. A"tethering attachment point" (TAP), in some embodiments, refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier may include a functional group, e.g., an amino group, or generally, provide a bond, that is suitable for incorporation or tethering of another chemical entity, e.g., a ligand to the constituent ring.

In some embodiments the dsRNA agent is conjugated to a ligand via a carrier, wherein the carrier can be cyclic group or acyclic group; e.g., the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; e.g., the acyclic group is selected from serinol backbone or diethanolamine backbone. The dsRNA agent may optionally be conjugated to one or more ligands. The ligand can be attached to the sense strand, antisense strand or both strands, at the 3'-end, 5'-end or both ends. For instance, the ligand may be conjugated to the sense strand, in particular, the 3'-end of the sense strand.

In some embodiments, the dsRNA is modified to promote stability. Stabilization of synthetic siRNA, such as a dsRNA herein, against rapid nuclease degradation may be regarded as a prerequisite for in vivo and therapeutic applications. This can be achieved using a variety of stabilization chemistries previously developed for other nucleic acid drugs, such as ribozymes and antisense molecules. These include chemical modifications to the native 2'-OH group in the ribose sugar backbone, such as 2'-O-methyl (2'OMe) and 2'-Fluoro (2'F) substitutions that can be readily introduced into siRNA as 2'-modified nucleotides during RNA synthesis. In some cases, the introduction of chemical modifications to native siRNA duplexes can have a negative impact on RNAi activity, therefore the design of chemically modified siRNA may require a stochastic screening approach to identify duplexes that retain potent gene silencing activity.

In some cases, when cleavage of the sense strand is inhibited, the endonucleo lytic cleavage of target mRNA is impaired In some cases, incorporation of a 2'-0-Me ribose to the Ago2 cleavage site in the sense strand inhibits RNAi. In some cases, with regard to phosphorothioate modifications, cleavage of the sense strand may be required for efficient RNAi.

In some cases, the dsRNA agent comprises 2'-F modified residues, e.g., at the Ago2 cleavage site. The modification may or may not be motif specific, e.g., one modification includes 2'-F modifications on all pyrimidines on both sense and antisense strands as long as pyrimidine residue is present, without any selectivity.

In some cases, the dsRNA agent comprises two 2'-F modified residues, e.g., at the Ago2 cleavage site, on the sense and/or antisense strand. In some cases, for each particular strand, either all pyrimidines or all purines are modified.

In some cases, the dsRNA agent comprises 2'-OMe modifications or various combinations of 2'-F, 2'-OMe and phosphorothioate modifications to stabilize the siRNA. In some cases, the residues at the cleavage site of the antisense strand are not be modified with 2'-OMe in order to increase the stability of the siRNA siRNAs In some embodiments, the composition comprises an oligonucleotide that targets ANGPTL7, wherein the oligonucleotide comprises a small interfering RNA (siRNA). In some embodiments, the composition comprises an oligonucleotide that targets ANGPTL7, wherein the oligonucleotide comprises an siRNA comprising a sense strand and an antisense strand. In some embodiments, the siRNA comprises a double stranded agent described herein.

In some embodiments, the composition comprises an oligonucleotide that inhibits the expression of ANGPTL7, wherein the oligonucleotide comprises a siRNA comprising a sense strand and an antisense strand, wherein the sense strand is 14-30 nucleosides in length. In some embodiments, the composition comprises a sense strange that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the composition comprises an antisense strand is 14-30 nucleosides in length. In some embodiments, the composition comprises an antisense strange that is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers.

In some embodiments, the composition comprises an oligonucleotide that inhibits the expression of ANGPTL7, wherein the oligonucleotide comprises a siRNA comprising a sense strand and an antisense strand, each strand is independently about 14-30 nucleosides in length, and at least one of the sense strand and the antisense strand comprises a nucleoside sequence comprising about 14-30 contiguous nucleosides of a full-length human ANGPTL7 mRNA sequence such as SEQ ID NO: 11085. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 11085.

In some embodiments, the composition comprises an oligonucleotide that inhibits the expression of ANGPTL7, wherein the oligonucleotide comprises a siRNA comprising a sense strand and an antisense strand, each strand is independently about 14-30 nucleosides in length, and at least one of the sense strand and the antisense strand comprises a nucleoside sequence comprising about 14-30 contiguous nucleosides of a full-length human ANGPTL7 mRNA sequence such as SEQ ID NO: 11086. In some embodiments, at least one of the sense strand and the antisense strand comprise a nucleoside sequence comprising at least about 10, 11, 12, 13, 14, 15, 15, 17, 18, 19, 20, 21, 22, 23, 24, 25, 26, 27, 28, 29, 30, or more contiguous nucleosides of one of SEQ ID NO: 11086.

In some embodiments, the composition comprises an oligonucleotide that inhibits the expression of ANGPTL7, wherein the oligonucleotide comprises a siRNA comprising a sense strand and an antisense strand, wherein the sense strand and the antisense strand forma double-stranded RNA duplex. In some embodiments, the first base pair of the double-stranded RNA duplex is an AU base pair.

In some embodiments, the sense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the sense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides.

In some embodiments, the antisense strand further comprises a 3' overhang. In some embodiments, the 3' overhang comprises 1, 2, 3, 4, 5, 6, 7, 8, 9, or 10 nucleosides, or a range of nucleotides defined by any two of the aforementioned numbers. In some embodiments, the 3' overhang comprises 1, 2, or more nucleosides. In some embodiments, the 3' overhang comprises 2 nucleosides. In some embodiments, the antisense strand further comprises a 5' overhang. In some embodiments, the 5' overhang comprises 1, 2, 3, 4, 5, 6, 7, 8, 9, or 10 nucleosides, or a range of nucleotides defined by any two of the aforementioned numbers. In some embodiments, the 5' overhang comprises 1, 2, or more nucleosides. In some embodiments, the 5' overhang comprises 2 nucleosides.

In some embodiments, the composition comprises an oligonucleotide that inhibits the expression of ANGPTL7, wherein the oligonucleotide comprises a siRNA comprising a sense strand and an antisense strand, wherein the siRNA binds with a 19mer in a human ANGPTL7 mRNA. In some embodiments, the siRNA binds with a 12mer, a 13mer, a 14mer, a 15mer, a 16mer, a 17mer, a 18mer, a 19mer, a 20mer, a 21mer, a 22mer, a 23mer, a 24mer, or a 25mer in a human ANGPTL7 mRNA In some embodiments, the composition comprises an oligonucleotide that inhibits the expression of ANGPTL7, wherein the oligonucleotide comprises a siRNA comprising a sense strand and an antisense strand, wherein the siRNA binds with a 17mer in a non-human primate ANGPTL7 mRNA. In some embodiments, the siRNA binds with a 12mer, a 13mer, a 14mer, a 15mer, a 16mer, a 17mer, a 18mer, a 19mer, a 20mer, a 21mer, a 22mer, a 23mer, a 24mer, or a 25mer in anon-human primate ANGPTL7 mRNA In some embodiments, the composition comprises an oligonucleotide that inhibits the expression of ANGPTL7, wherein the oligonucleotide comprises a siRNA comprising a sense strand and an antisense strand, wherein the siRNA binds with a 19mer in a human ANGPTL7 mRNA, or a combination thereof. In some embodiments, the siRNA binds with a 12mer, a 13mer, a 14mer, a 15mer, a 16mer, a 17mer, and 18mer, a 19mer, a 20mer, a 21mer, a 22mer, a 23mer, a 24mer, or a 25mer in a human ANGPTL7 mRNA In some embodiments, the composition comprises an oligonucleotide that inhibits the expression of ANGPTL7, wherein the oligonucleotide comprises a siRNA comprising a sense strand and an antisense strand, wherein the siRNA binds with a human ANGPTL7 mRNA and less than or equal to 20 human off-targets, with no more than 2 mismatches in the antisense strand. In some embodiments, the siRNA binds with a human ANGPTL7 mRNA and less than or equal to 10 human off-targets, with no more than 2 mismatches in the antisense strand. In some embodiments, the siRNA binds with a human ANGPTL7 mRNA and less than or equal to 30 human off-targets, with no more than 2 mismatches in the antisense strand. In some embodiments, the siRNA binds with a human ANGPTL7 mRNA and less than or equal to 40 human off-targets, with no more than 2 mismatches in the antisense strand. In some embodiments, the siRNA binds with a human ANGPTL7 mRNA and less than or equal to 50 human off-targets, with no more than 2 mismatches in the antisense strand. In some embodiments, the siRNA binds with a human ANGPTL7 mRNA and less than or equal to 10 human off-targets, with no more than 3 mismatches in the antisense strand. In some embodiments, the siRNA binds with a human ANGPTL7 mRNA and less than or equal to 20 human off-targets, with no more than 3 mismatches in the antisense strand. In some embodiments, the siRNA binds with a human ANGPTL7 mRNA and less than or equal to 30 human off-targets, with no more than 3 mismatches in the antisense strand. In some embodiments, the siRNA binds with a human ANGPTL7 mRNA and less than or equal to 40 human off-targets, with no more than 3 mismatches in the antisense strand. In some embodiments, the siRNA binds with a human ANGPTL7 mRNA and less than or equal to 50 human off-targets, with no more than 3 mismatches in the antisense strand.

In some embodiments, the composition comprises an oligonucleotide that inhibits the expression of ANGPTL7, wherein the oligonucleotide comprises a siRNA comprising a sense strand and an antisense strand. In some embodiments, the siRNA binds with a human ANGPTL7 mRNA target site that does not harbor an SNP, with a minor allele frequency (MAF) greater or equal to 1% (pos. 2-18). In some embodiments, the MAF is greater or equal to about 2%, about 3%, about 4%, about 5%, about 6%, about 7%, about 8%, about 9%, about 10%, about 11%, about 12%, about 13%, about 14%, about 15%, about 16%, about 17%, about 18%, about 19%, or about 20%.

In some embodiments, the siRNA binds with a human ANGPTL7 mRNA with no more than 2 mismatches in the antisense strand. In some embodiments, the siRNA binds with a human ANGPTL7 mRNA target site that does not harbor an SNP, with a minor allele frequency (MAF) greater or equal to 1% (pos. 2-18). In some embodiments, the sense strand and the antisense strand each comprise a seed region that is not identical to a seed region of a human miRNA. In some embodiments, the sense strand comprises a seed region that is not identical to a seed region of a human miRNA. In some embodiments, the antisense strand comprises a seed region that is not identical to a seed region of a human miRNA In some embodiments, the composition comprises an oligonucleotide that inhibits the expression of ANGPTL7, wherein the oligonucleotide comprises a siRNA comprising a sense strand and an antisense strand. In some embodiments, the oligonucleotide comprises a nucleic acid sequence (e.g. a sense strand sequence or an antisense strand sequence). In some embodiments, the sense strand comprises a sense strand sequence. In some embodiments, the antisense strand comprises an antisense strand sequence. In some embodiments, the nucleic acid sequence comprises or consists of sequence at least 75% identical to of any one of SEQ ID NOs: 1-4412, at least 80% identical to of any one of SEQ ID NOs: 1-4412, at least 85% identical to of any one of SEQ ID NOs: 1-4412, at least 90% identical to of any one of SEQ ID NOs: 1-4412, or at least 95% identical to of any one of SEQ ID NOs: 1-4412. In some embodiments, the nucleic acid sequence comprises or consists of the sequence of any one of SEQ ID NOs: 1-4412, or a nucleic acid sequence thereof having 1, 2, 3, or 4 nucleoside substitutions, additions, or deletions. In some embodiments, the nucleic acid sequence comprises or consists of the sequence of any one of SEQ ID NOs: 1-4412, or a nucleic acid sequence thereof having 1 or 2 nucleoside substitutions, additions, or deletions. In some embodiments, the nucleic acid sequence comprises or consists of the sequence of any one of SEQ ID NOs: 1-4412. In some embodiments, the oligonucleotide comprises an overhang described herein. In some embodiments, the oligonucleotide comprises on or more modifications or modification patterns described herein.

In some embodiments, the oligonucleotide comprises or consists of any one of the siRNAs of siRNA subset A, or an siRNA thereof having 1 or 2 nucleoside substitutions, additions, or deletions. In some embodiments, the oligonucleotide comprises or consists of any one of the siRNAs of siRNA subset A. In some embodiments, the oligonucleotide comprises or consists of any one of the siRNAs of siRNA subset B, or an siRNA thereof having 1 or 2 nucleoside substitutions, additions, or deletions. In some embodiments, the oligonucleotide comprises or consists of any one of the siRNAs of siRNA subset B. In some embodiments, the oligonucleotide comprises or consists of any one of the siRNAs of siRNA subset C, or an siRNA thereof having 1 or 2 nucleoside substitutions, additions, or deletions. In some embodiments, the oligonucleotide comprises or consists of any one of the siRNAs of siRNA subset C. In some embodiments, the oligonucleotide comprises or consists of any one of the siRNAs of siRNA subset D, or an siRNA thereof having 1 or 2 nucleoside substitutions, additions, or deletions. In some embodiments, the oligonucleotide comprises or consists of any one of the siRNAs of siRNA subset D. In some embodiments, the oligonucleotide comprises or consists of any one of the siRNAs of siRNA subset E, or an siRNA thereof having 1 or 2 nucleoside substitutions, additions, or deletions. In some embodiments, the oligonucleotide comprises or consists of any one of the siRNAs of siRNA subset E.

In some embodiments, the sense strand sequence comprises or consists of sequence at least 75% identical to of any one of SEQ ID NOs: 1-2206, at least 80% identical to of any one of SEQ ID NOs: 1-2206, at least 85% identical to of any one of SEQ ID NOs: 1-2206, at least 90% identical to of any one of SEQ ID NOs: 1-2206, or at least 95% identical to of any one of SEQ ID NOs: 1-2206. In some embodiments, the sense strand sequence comprises or consists of the sequence of any one of SEQ ID NOs: 1-2206, or a sense strand sequence thereof having 1, 2, 3, or 4 nucleoside substitutions, additions, or deletions. In some embodiments, the sense strand sequence comprises or consists of the sequence of any one of SEQ ID NOs: 1-2206, or a sense strand sequence thereof having 1 or 2 nucleoside substitutions, additions, or deletions. In some embodiments, the sense strand sequence comprises or consists of the sequence of any one of SEQ ID NOs: 1-2206. In some embodiments, the sense strand comprises an overhang described herein. In some embodiments, the sense strand comprises on or more modifications or modification patterns described herein.

In some embodiments, the sense strand sequence comprises or consists of sequence at least 75% identical, at least 80% identical, at least 85% identical, at least 90% identical, or at least 95% identical to of any one of SEQ ID NOs: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192. In some embodiments, the sense strand sequence comprises or consists of the sequence of any one of SEQ ID NOs: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192, or a sense strand sequence thereof having 1, 2, 3, or 4 nucleoside substitutions, additions, or deletions. In some embodiments, the sense strand sequence comprises or consists of the sequence of any one of SEQ ID NOs: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192, or a sense strand sequence thereof having 1 or 2 nucleoside substitutions, additions, or deletions. In some embodiments, the sense strand sequence comprises or consists of the sequence of any one of SEQ ID NOs: 7, 92, 93, 94, 115, 117, 118, 120, 206, 207, 256, 645, 646, 657, 740, 741, 743, 923, 943, 948, 1021, 1092, 1094, 1097, 1105, 1107, 1132, 1198, 1201, 1424, 1425, 1429, 1434, 1436, 1438, 1537, 1541, 1639, 1654, 1691, 1693, 1762, 1764, 1765, 1794, 1796, 1797, 1968, 1969, 2030, 2085, 2087, 2091, 2095, 2099, or 2192. In some embodiments, the sense strand comprises an overhang described herein.

In some embodiments, the sense strand comprises or consists of a sense strand of any one of the siRNAs of siRNA subset A, or a sense strand thereof having 1 or 2 nucleoside substitutions, additions, or deletions. In some embodiments, the sense strand comprises or consists of a sense strand of any one of the siRNAs of siRNA subset A. In some embodiments, the sense strand comprises or consists of a sense strand of any one of the siRNAs of siRNA subset B, or a sense strand thereof having 1 or 2 nucleoside substitutions, additions, or deletions. In some embodiments, the sense strand comprises or consists of a sense strand of any one of the siRNAs of siRNA subset B. In some embodiments, the sense strand comprises or consists of a sense strand of any one of the siRNAs of siRNA subset C, or a sense strand thereof having 1 or 2 nucleoside substitutions, additions, or deletions. In some embodiments, the sense strand comprises or consists of a sense strand of any one of the siRNAs of siRNA subset C. In some embodiments, the sense strand comprises or consists of a sense strand of any one of the siRNAs of siRNA subset D, or a sense strand thereof having 1 or 2 nucleoside substitutions, additions, or deletions. In some embodiments, the sense strand comprises or consists of a sense strand of any one of the siRNAs of siRNA subset D. In some embodiments, the sense strand comprises or consists of a sense strand of any one of the siRNAs of siRNA subset E, or a sense strand thereof having 1 or 2 nucleoside substitutions, additions, or deletions. In some embodiments, the sense strand comprises or consists of a sense strand of any one of the siRNAs of siRNA subset E.

In some embodiments, the sense strand sequence comprises or consists of the sequence of SEQ ID NO: 11089, or a sense strand sequence thereof having 1 or 2 nucleoside substitutions, additions, or deletions. In some embodiments, the sense strand sequence comprises or consists of the sequence of SEQ ID NO: 11089.

In some embodiments, the antisense strand sequence comprises or consists of sequence at least 75% identical to of any one of SEQ ID NOs: 2207-4412, at least 80% identical to of any one of SEQ ID NOs: 2207-4412, at least 85% identical to of any one of SEQ ID NOs: 2207-4412, at least 90% identical to of any one of SEQ ID NOs: 2207-4412, or at least 95% identical to of any one of SEQ ID NOs: 2207-4412. In some embodiments, the antisense strand sequence comprises or consists of the sequence of any one of SEQ ID NOs: 2207-4412, or an antisense strand sequence thereof having 1, 2, 3, or 4 nucleoside substitutions, additions, or deletions. In some embodiments, the antisense strand sequence comprises or consists of the sequence of any one of SEQ ID NOs: 2207-4412, or an antisense strand sequence thereof having 1 or 2 nucleoside substitutions, additions, or deletions. In some embodiments, the antisense strand sequence comprises or consists of the sequence of any one of SEQ ID NOs: 2207-4412. In some embodiments, the antisense strand comprises an overhang described herein. In some embodiments, the antisense strand comprises on or more modifications or modification patterns described herein.

In some embodiments, the antisense strand sequence comprises or consists of sequence at least 75% identical, at least 80% identical, at least 85% identical, at least 90% identical, or at least 95% identical to of any one of SEQ ID NOs: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398. In some embodiments, the antisense strand sequence comprises or consists of the sequence of any one of SEQ ID NOs: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398, or an antisense strand sequence thereof having 1, 2, 3, or 4 nucleoside substitutions, additions, or deletions. In some embodiments, the antisense strand sequence comprises or consists of the sequence of any one of SEQ ID NOs: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398, or an antisense strand sequence thereof having 1 or 2 nucleoside substitutions, additions, or deletions. In some embodiments, the antisense strand sequence comprises or consists of the sequence of any one of SEQ ID NOs: 2213, 2298, 2299, 2300, 2321, 2323, 2324, 2326, 2412, 2413, 2462, 2851, 2852, 2863, 2946, 2947, 2949, 3129, 3149, 3154, 3227, 3298, 3300, 3303, 3311, 3313, 3338, 3404, 3407, 3630, 3631, 3635, 3640, 3642, 3644, 3743, 3747, 3845, 3860, 3897, 3899, 3968, 3970, 3971, 4000, 4002, 4003, 4174, 4175, 4236, 4291, 4293, 4297, 4301, 4305, or 4398. In some embodiments, the antisense strand comprises an overhang described herein. In some embodiments, the antisense strand comprises on or more modifications or modification patterns described herein.

In some embodiments, the antisense strand comprises or consists of an antisense strand of any one of the siRNAs of siRNA subset A, or an antisense strand thereof having 1 or 2 nucleoside substitutions, additions, or deletions. In some embodiments, the antisense strand comprises or consists of an antisense strand of any one of the siRNAs of siRNA subset A. In some embodiments, the antisense strand comprises or consists of an antisense strand of any one of the siRNAs of siRNA subset B, or an antisense strand thereof having 1 or 2 nucleoside substitutions, additions, or deletions. In some embodiments, the antisense strand comprises or consists of an antisense strand of any one of the siRNAs of siRNA subset B. In some embodiments, the antisense strand comprises or consists of an antisense strand of any one of the siRNAs of siRNA subset C, or an antisense strand thereof having 1 or 2 nucleoside substitutions, additions, or deletions. In some embodiments, the antisense strand comprises or consists of an antisense strand of any one of the siRNAs of siRNA subset C. In some embodiments, the antisense strand comprises or consists of an antisense strand of any one of the siRNAs of siRNA subset D, or an antisense strand thereof having 1 or 2 nucleoside substitutions, additions, or deletions. In some embodiments, the antisense strand comprises or consists of an antisense strand of any one of the siRNAs of siRNA subset D. In some embodiments, the antisense strand comprises or consists of an antisense strand of any one of the siRNAs of siRNA subset E, or an antisense strand thereof having 1 or 2 nucleoside substitutions, additions, or deletions. In some embodiments, the antisense strand comprises or consists of an antisense strand of any one of the siRNAs of siRNA subset E.

In some embodiments, the antisense strand sequence comprises or consists of the sequence of SEQ ID NO: 11090, or an antisense strand sequence thereof having 1 or 2 nucleoside substitutions, additions, or deletions. In some embodiments, the antisense strand sequence comprises or consists of the sequence of SEQ ID NO: 11090.

siRNA Modification Patterns

The oligonucleotides described herein (e.g. siRNAs, antisense oligonucleotides, sense strands, antisense strands, siRNA agents, or dsRNA agents) may include any modification pattern disclosed herein, including but not limited to any one or more of modification patterns 1S-5S, 1AS-4AS, or ASO1.

In some embodiments, the composition comprises an oligonucleotide that inhibits the expression of ANGPTL7 wherein the oligonucleotide comprises a siRNA comprising a sense strand and an antisense strand, wherein the sense strand comprises modification pattern 1S: 5' NfsnsNfnNfnNfNfNfnNfnNfnNfnNfnNfnNfsnsn-3' (SEQ ID NO: 11381), wherein "Nf" is a 2' fluoro-modified nucleoside, "n" is a 2' O-methyl modified nucleoside, and "s" is a phosphorothioate linkage. In some embodiments, the sense strand comprises modification pattern 2S: 5' nsnsnnNfnNfNfNfnnnnnnnnnnnsnsn-3' (SEQ ID NO: 11382), wherein "Nf" is a 2' fluoro-modified nucleoside, "n" is a 2' O-methyl modified nucleoside, and "s" is a phosphorothioate linkage. In some embodiments, the sense strand comprises modification pattern 3S: 5' nsnsnnNfnNfnNfnnnnnnnnnnnsnsn-3' (SEQ ID NO: 11383), wherein "Nf" is a 2' fluoro-modified nucleoside, "n" is a 2' O-methyl modified nucleoside, and "s" is a phosphorothioate linkage. In some embodiments, the sense strand comprises modification pattern 4S: 5' NfsnsNfnNfnNfNfNfnNfnNfnNfnNfnNfsnsnN-Lipid-3' (SEQ ID NO: 11384), wherein "Nf" is a 2' fluoro-modified nucleoside, "n" is a 2' O-methyl modified nucleoside, "s" is a phosphorothioate linkage, and N comprises a nucleoside. In some embodiments, the sense strand comprises modification pattern 5S: 5'-nsnsnnNfnNfNfNfnnnnnnnnnnnsnsnN-Lipid-3' (SEQ ID NO: 11385), wherein "Nf" is a 2' fluoro-modified nucleoside, "n" is a 2' O-methyl modified nucleoside, "s" is a phosphorothioate linkage, and N comprises a nucleoside.

In some embodiments, the composition comprises an oligonucleotide that inhibits the expression of ANGPTL7 wherein the oligonucleotide comprises a siRNA comprising a sense strand and an antisense strand, wherein the antisense strand comprises modification pattern 1AS: 5'-nsNfsnNfnNfnNfnNfnnnNfnNfnNfsnsn-3' (SEQ ID NO: 11386), wherein "Nf" is a 2' fluoro-modified nucleoside, "n" is a 2' O-methyl modified nucleoside, and "s" is a phosphorothioate linkage. In some embodiments, the antisense strand comprises modification pattern 2AS: 5' nsNfsnnnNfnNfNfnnnnNfnNfnnnsnsn-3' (SEQ ID NO: 11387), wherein "Nf" is a 2' fluoro-modified nucleoside, "n" is a 2' O-methyl modified nucleoside, and "s" is a phosphorothioate linkage. In some embodiments, the antisense strand comprises modification pattern 3AS: 5' nsNfsnnnNfnnnnnnnNfnNfnnnsnsn-3' (SEQ ID NO: 11388), wherein "Nf" is a 2' fluoro-modified nucleoside, "n" is a 2' O-methyl modified nucleoside, and "s" is a phosphorothioate linkage. In some embodiments, the antisense strand comprises modification pattern 4AS: 5' nsNfsnNfnNfnnnnnnnnNfnNfnnnsnsn 3' (SEQ ID NO: 11389), wherein "Nf" is a 2' fluoro-modified nucleoside, "n" is a 2' O-methyl modified nucleoside, and "s" is a phosphorothioate linkage.

In some embodiments, the composition comprises an oligonucleotide that inhibits the expression of ANGPTL7 wherein the oligonucleotide comprises a siRNA comprising a sense strand and an antisense strand, wherein the sense strand comprises pattern 1S and the antisense strand comprises pattern 1AS, 2AS, 3AS, or 4AS. In some embodiments, the sense strand comprises pattern 2S and the antisense strand comprises pattern 1AS, 2AS, 3AS, or 4AS. In some embodiments, the sense strand comprises pattern 3S and the antisense strand comprises pattern 1AS, 2AS, 3AS, or 4AS. In some embodiments, the sense strand comprises pattern 4S and the antisense strand comprises pattern 1AS, 2AS, 3AS, or 4AS. In some embodiments, the sense strand comprises modification pattern 1AS, 2AS, 3AS, or 4AS. In some embodiments, the antisense strand comprises modification pattern 1S, 2S, 3S, 4S, or 5S. In some embodiments, the sense strand or the antisense strand comprises modification pattern ASO1.

In some embodiments, the composition comprises an oligonucleotide that inhibits the expression of ANGPTL7, wherein the oligonucleotide comprises a siRNA comprising a sense strand and an antisense strand, wherein the sense strand and/or the antisense strand comprises one or more modifications or modification patterns. In some embodiments, the oligonucleotide comprises a nucleic acid sequence (e.g. a sense strand sequence or an antisense strand sequence) with one or more modifications or modification patterns.

In some embodiments, the nucleic acid sequence comprises or consists of sequence at least 75% identical to of any one of SEQ ID NOs: 11093-11332, at least 80% identical to of any one of SEQ ID NOs: 11093-11332, at least 85% identical to of any one of SEQ ID NOs: 11093-11332, at least 90% identical to of any one of SEQ ID NOs: 11093-11332, or at least 95% identical to of any one of SEQ ID NOs: 11093-11332. In some embodiments, the nucleic acid sequence comprises or consists of the sequence of any one of SEQ ID NOs: 11093-11332, or a sequence thereof having 1, 2, 3, or 4 nucleoside substitutions, additions, or deletions. In some embodiments, the nucleic acid sequence comprises or consists of the sequence of any one of SEQ ID NOs: 11093-11332, or a sequence thereof having 1 or 2 nucleoside substitutions, additions, or deletions. In some embodiments, the nucleic acid sequence comprises or consists of the sequence of any one of SEQ ID NOs: 11093-11332. In some embodiments, the nucleic acid sequence is an unmodified version of a nucleic acid sequence described herein. In some embodiments, the nucleic acid sequence has more or different sequence modifications than a nucleic acid sequence described herein.

In some embodiments, the nucleic acid sequence comprises or consists of sequence at least 75% identical to of any one of SEQ ID NOs: 11333-11376, at least 80% identical to of any one of SEQ ID NOs: 11333-11376, at least 85% identical to of any one of SEQ ID NOs: 11333-11376, at least 90% identical to of any one of SEQ ID NOs: 11333-11376, or at least 95% identical to of any one of SEQ ID NOs: 11333-11376. In some embodiments, the nucleic acid sequence comprises or consists of the sequence of any one of SEQ ID NOs: 11333-11376, or a sequence thereof having 1, 2, 3, or 4 nucleoside substitutions, additions, or deletions. In some embodiments, the nucleic acid sequence comprises or consists of the sequence of any one of SEQ ID NOs: 11333-11376, or a sequence thereof having 1 or 2 nucleoside substitutions, additions, or deletions. In some embodiments, the nucleic acid sequence comprises or consists of the sequence of any one of SEQ ID NOs: 11333-11376. In some embodiments, the nucleic acid sequence lacks the sequence modifications, or has different or additional sequence modifications, but otherwise is similar to a sequence described herein.

In some embodiments, the oligonucleotide comprises or consists of any one of the siRNAs disclosed in any of Tables 5-13, or an siRNA thereof having 1 or 2 nucleoside substitutions, additions, or deletions. In some embodiments, the oligonucleotide comprises or consists of any one of the siRNAs disclosed in any of Tables 5-13. In some embodiments, the oligonucleotide comprises a nucleoside sequence at least 85% identical the sense strand sequence of an siRNA in any of Tables 5-13

In some embodiments, the oligonucleotide comprises or consists of any one of the siRNAs disclosed in any of Tables 5-10, or an siRNA thereof having 1 or 2 nucleoside substitutions, additions, or deletions. In some embodiments, the oligonucleotide comprises or consists of any one of the siRNAs disclosed in any of Tables 5-10. In some embodiments, the oligonucleotide comprises or consists of any one of the siRNAs disclosed in any of Tables 5-10 where a relative ANGPTL expression in the table is below 1, or an siRNA thereof having 1 or 2 nucleoside substitutions, additions, or deletions. In some embodiments, the oligonucleotide comprises or consists of any one of the siRNAs disclosed in any of Tables 5-10 where a relative ANGPTL expression in the table is below 1. In some embodiments, the oligonucleotide comprises or consists of any one of the siRNAs disclosed in any of Tables 5-10 where a relative ANGPTL expression of the siRNA in the table is below the expression of a negative control in the table, or an siRNA thereof having 1 or 2 nucleoside substitutions, additions, or deletions. In some embodiments, the oligonucleotide comprises or consists of any one of the siRNAs disclosed in any of Tables 5-10 where a relative ANGPTL expression of the siRNA in the table is below the expression of a negative control in the table. In some embodiments, the oligonucleotide comprises or consists of any one of the siRNAs disclosed in any of Tables 5-10 where a relative ANGPTL expression in the table is below 0.5, or an siRNA thereof having 1 or 2 nucleoside substitutions, additions, or deletions. In some embodiments, the oligonucleotide comprises or consists of any one of the siRNAs disclosed in any of Tables 5-10 where a relative ANGPTL expression in the table is below 0.5. In some embodiments, the oligonucleotide comprises or consists of any one of the siRNAs disclosed in any of Tables 5-10 where a relative ANGPTL expression in the table is below 0.25, or an siRNA thereof having 1 or 2 nucleoside substitutions, additions, or deletions. In some embodiments, the oligonucleotide comprises or consists of any one of the siRNAs disclosed in any of Tables 5-10 where a relative ANGPTL expression in the table is below 0.25. In some embodiments, the oligonucleotide comprises or consists of an unmodified version of any one of the siRNAs disclosed in any of Tables 5-10. In some embodiments, the oligonucleotide comprises or consists of an siRNA with the nucleic acid sequence of any one of the siRNAs disclosed in any of Tables 5-10, but with one or more additional or different modifications, or with a different modification pattern. In some embodiments, the nucleic acid sequence lacks the sequence modifications, or has different or additional sequence modifications, but otherwise is similar to a sequence described herein.

In some embodiments, the sense strand comprises a sense strand sequence with one or more modifications or modification patterns. In some embodiments, the sense strand sequence comprises or consists of sequence at least 75% identical to of any one of SEQ ID NOs: 11093-11212, at least 80% identical to of any one of SEQ ID NOs: 11093-11212, at least 85% identical to of any one of SEQ ID NOs: 11093-11212, at least 90% identical to of any one of SEQ ID NOs: 11093-11212, or at least 95% identical to of any one of SEQ ID NOs: 11093-11212. In some embodiments, the sense strand sequence comprises or consists of the sequence of any one of SEQ ID NOs: 11093-11212, or a sequence thereof having 1, 2, 3, or 4 nucleoside substitutions, additions, or deletions. In some embodiments, the sense strand sequence comprises or consists of the sequence of any one of SEQ ID NOs: 11093-11212, or a sequence thereof having 1 or 2 nucleoside substitutions, additions, or deletions. In some embodiments, the sense strand sequence comprises or consists of the sequence of any one of SEQ ID NOs: 11093-11212. In some embodiments, the sense strand sequence is an unmodified version of a sense strand sequence described herein. In some embodiments, the sense strand sequence has more or different sequence modifications than a sense strand sequence described herein.

In some embodiments, the sense strand sequence comprises or consists of sequence at least 75% identical to of any one of SEQ ID NOs: 11333-11354, at least 80% identical to of any one of SEQ ID NOs: 11333-11354, at least 85% identical to of any one of SEQ ID NOs: 11333-11354, at least 90% identical to of any one of SEQ ID NOs: 11333-11354, or at least 95% identical to of any one of SEQ ID NOs: 11333-11354. In some embodiments, the sense strand sequence comprises or consists of the sequence of any one of SEQ ID NOs: 11333-11354, or a sequence thereof having 1, 2, 3, or 4 nucleoside substitutions, additions, or deletions. In some embodiments, the sense strand sequence comprises or consists of the sequence of any one of SEQ ID NOs: 11333-11354, or a sequence thereof having 1 or 2 nucleoside substitutions, additions, or deletions. In some embodiments, the sense strand sequence comprises or consists of the sequence of any one of SEQ ID NOs: 11333-11354. In some embodiments, the sense strand sequence lacks the sequence modifications, or has different or additional sequence modifications, but otherwise is similar to a sequence described herein.

In some embodiments, the sense strand sequence comprises or consists of a sense strand sequence of a sense strand sequence of any one of the siRNAs disclosed in any of Tables 5-13, or an siRNA thereof having 1 or 2 nucleoside substitutions, additions, or deletions. In some embodiments, the sense strand sequence comprises or consists of a sense strand sequence of a sense strand sequence of any one of the siRNAs disclosed in any of Tables 5-13. In some embodiments, the sense strand sequence comprises or consists of a sequence at least 75% identical, at least 80% identical, at least 85% identical, at least 90% identical, or at least 95% identical to a sense strand sequence of an siRNA in any of Tables 5-13.

In some embodiments, the sense strand sequence comprises or consists of a sense strand sequence of a sense strand sequence of any one of the siRNAs disclosed in any of Tables 5-10, or an siRNA thereof having 1 or 2 nucleoside substitutions, additions, or deletions. In some embodiments, the sense strand sequence comprises or consists of a sense strand sequence of any one of the siRNAs disclosed in any of Tables 5-10. In some embodiments, the sense strand sequence comprises or consists of a sense strand sequence of any one of the siRNAs disclosed in any of Tables 5-10 where a relative ANGPTL expression in the table is below 1, or an siRNA thereof having 1 or 2 nucleoside substitutions, additions, or deletions. In some embodiments, the sense strand sequence comprises or consists of a sense strand sequence of any one of the siRNAs disclosed in any of Tables 5-10 where a relative ANGPTL expression in the table is below 1. In some embodiments, the sense strand sequence comprises or consists of a sense strand sequence of any one of the siRNAs disclosed in any of Tables 5-10 where a relative ANGPTL expression of the siRNA in the table is below the expression of a negative control in the table, or an siRNA thereof having 1 or 2 nucleoside substitutions, additions, or deletions. In some embodiments, the sense strand sequence comprises or consists of a sense strand sequence of any one of the siRNAs disclosed in any of Tables 5-10 where a relative ANGPTL expression of the siRNA in the table is below the expression of a negative control in the table. In some embodiments, the sense strand sequence comprises or consists of a sense strand sequence of any one of the siRNAs disclosed in any of Tables 5-10 where a relative ANGPTL expression in the table is below 0.5, or an siRNA thereof having 1 or 2 nucleoside substitutions, additions, or deletions. In some embodiments, the sense strand sequence comprises or consists of a sense strand sequence of any one of the siRNAs disclosed in any of Tables 5-10 where a relative ANGPTL expression in the table is below 0.5. In some embodiments, the sense strand sequence comprises or consists of a sense strand sequence of any one of the siRNAs disclosed in any of Tables 5-10 where a relative ANGPTL expression in the table is below 0.25, or an siRNA thereof having 1 or 2 nucleoside substitutions, additions, or deletions. In some embodiments, the sense strand sequence comprises or consists of a sense strand sequence of any one of the siRNAs disclosed in any of Tables 5-10 where a relative ANGPTL expression in the table is below 0.25. In some embodiments, the sense strand sequence comprises or consists of an unmodified version of a sense strand sequence of any one of the siRNAs disclosed in any of Tables 5-10. In some embodiments, the sense strand sequence comprises or consists of an siRNA with the sense strand sequence of a sense strand sequence of any one of the siRNAs disclosed in any of Tables 5-10, but with one or more additional or different modifications, or with a different modification pattern. In some embodiments, the sense strand sequence lacks the sequence modifications, or has different or additional sequence modifications, but otherwise is similar to a sequence described herein.

In some embodiments, the sense strand sequence comprises or consists of a sense strand sequence of any one of the siRNAs disclosed in Table 5, or an siRNA thereof having 1 or 2 nucleoside substitutions, additions, or deletions. In some embodiments, the sense strand sequence comprises or consists of a sense strand sequence of any one of the siRNAs disclosed in Table 5. In some embodiments, the sense strand sequence comprises or consists of a sense strand sequence of any one of the siRNAs disclosed in Table 5 where the relative ANGPTL expression in the table is below 1, or an siRNA thereof having 1 or 2 nucleoside substitutions, additions, or deletions. In some embodiments, the sense strand sequence comprises or consists of a sense strand sequence of any one of the siRNAs disclosed in Table 5 where the relative ANGPTL expression in the table is below 1. In some embodiments, the sense strand sequence comprises or consists of a sense strand sequence of any one of the siRNAs disclosed in Table 5 where the relative ANGPTL expression of the siRNA in the table is below the expression of the negative control siRNA in the table (e.g. below a relative expression level of 0.67), or an siRNA thereof having 1 or 2 nucleoside substitutions, additions, or deletions. In some embodiments, the sense strand sequence comprises or consists of a sense strand sequence of any one of the siRNAs disclosed in Table 5 where the relative ANGPTL expression of the siRNA in the table is below the expression of the negative control siRNA in the table (e.g. below a relative expression level of 0.67). In some embodiments, the sense strand sequence comprises or consists of a sense strand sequence of any one of the siRNAs disclosed in Table 5 where the relative ANGPTL expression in the table is below 0.5, or an siRNA thereof having 1 or 2 nucleoside substitutions, additions, or deletions. In some embodiments, the sense strand sequence comprises or consists of a sense strand sequence of any one of the siRNAs disclosed in Table 5 where the relative ANGPTL expression in the table is below 0.5. In some embodiments, the sense strand sequence comprises or consists of a sense strand sequence of any one of the siRNAs disclosed in Table 5 where the relative ANGPTL expression in the table is below 0.25, or an siRNA thereof having 1 or 2 nucleoside substitutions, additions, or deletions. In some embodiments, the sense strand sequence comprises or consists of a sense strand sequence of any one of the siRNAs disclosed in Table 5 where the relative ANGPTL expression in the table is below 0.25. In some embodiments, the sense strand sequence comprises or consists of an unmodified version of a sense strand sequence of any one of the siRNAs disclosed in Table 5. In some embodiments, the sense strand sequence comprises or consists of an siRNA with the sense strand sequence of a sense strand sequence of any one of the siRNAs disclosed in Table 5, but with one or more additional or different modifications, or with a different modification pattern. In some embodiments, the sense strand sequence lacks the sequence modifications, or has different or additional sequence modifications, but otherwise is similar to a sequence described herein.

In some embodiments, the sense strand sequence is incorporated into an siRNA that downregulates ANGPTL7. In some embodiments, the sense strand sequence comprises or consists of a sense strand sequence of any one of SEQ ID NOs: 11094, 11095, 11096, 11097, 11098, 11099, 11100, 11101, 11102, 11103, 11104, 11105, 11106, 11109, 11110, 11113, 11116, 11118, 11119, 11121, 11122, 11123, 11124, 11125, 11126, 11127, 11128, 11129, 11130, 11132, 11133, 11134, 11135, 11136, 11139, 11140, 11143, 11144, 11145, 11146, 11147, 11148, 11149, 11150, 11151, 11152, 11153, 11154, 11155, 11156, 11157, 11158, 11159, 11160, 11161, 11162, 11163, 11164, 11165, 11166, 11167, 11168, 11169, 11170, 11171, 11172, 11173, 11174, 11175, 11176, 11177, 11178, 11180, 11181, 11182, 11183, 11184, 11185, 11186, 11187, 11188, 11189, 11191, 11193, 11195, 11196, 11198, 11199, 11200, 11201, 11203, 11204, 11205, 11207, 11208, 11210, 11211, or 11212, or an siRNA thereof having 1 or 2 nucleoside substitutions, additions, or deletions. In some embodiments, the sense strand sequence comprises or consists of a sense strand sequence of any one of SEQ ID NOs: 11094, 11095, 11096, 11097, 11098, 11099, 11100, 11101, 11102, 11103, 11104, 11105, 11106, 11109, 11110, 11113, 11116, 11118, 11119, 11121, 11122, 11123, 11124, 11125, 11126, 11127, 11128, 11129, 11130, 11132, 11133, 11134, 11135, 11136, 11139, 11140, 11143, 11144, 11145, 11146, 11147, 11148, 11149, 11150, 11151, 11152, 11153, 11154, 11155, 11156, 11157, 11158, 11159, 11160, 11161, 11162, 11163, 11164, 11165, 11166, 11167, 11168, 11169, 11170, 11171, 11172, 11173, 11174, 11175, 11176, 11177, 11178, 11180, 11181, 11182, 11183, 11184, 11185, 11186, 11187, 11188, 11189, 11191, 11193, 11195, 11196, 11198, 11199, 11200, 11201, 11203, 11204, 11205, 11207, 11208, 11210, 11211, or 11212.

In some embodiments, the sense strand sequence comprises or consists of a sense strand sequence of any one of the siRNAs disclosed in Table 6, or an siRNA thereof having 1 or 2 nucleoside substitutions, additions, or deletions. In some embodiments, the sense strand sequence comprises or consists of a sense strand sequence of any one of the siRNAs disclosed in Table 6. In some embodiments, the sense strand sequence comprises or consists of a sense strand sequence of any one of the siRNAs disclosed in Table 6 where the relative ANGPTL expression in the table is below 1, or an siRNA thereof having 1 or 2 nucleoside substitutions, additions, or deletions. In some embodiments, the sense strand sequence comprises or consists of a sense strand sequence of any one of the siRNAs disclosed in Table 6 where the relative ANGPTL expression in the table is below 1. In some embodiments, the sense strand sequence comprises or consists of a sense strand sequence of any one of the siRNAs disclosed in Table 6 where the relative ANGPTL expression of the siRNA in the table is below the expression of the negative control siRNA in the table (e.g. below a relative expression level of 1.06), or an siRNA thereof having 1 or 2 nucleoside substitutions, additions, or deletions. In some embodiments, the sense strand sequence comprises or consists of a sense strand sequence of any one of the siRNAs disclosed in Table 6 where the relative ANGPTL expression of the siRNA in the table is below the expression of the negative control siRNA in the table (e.g. below a relative expression level of 1.06). In some embodiments, the sense strand sequence comprises or consists of a sense strand sequence of any one of the siRNAs disclosed in Table 6 where the relative ANGPTL expression in the table is below 0.5, or an siRNA thereof having 1 or 2 nucleoside substitutions, additions, or deletions. In some embodiments, the sense strand sequence comprises or consists of a sense strand sequence of any one of the siRNAs disclosed in Table 6 where the relative ANGPTL expression in the table is below 0.5. In some embodiments, the sense strand sequence comprises or consists of a sense strand sequence of any one of the siRNAs disclosed in Table 6 where the relative ANGPTL expression in the table is below 0.25, or an siRNA thereof having 1 or 2 nucleoside substitutions, additions, or deletions. In some embodiments, the sense strand sequence comprises or consists of a sense strand sequence of any one of the siRNAs disclosed in Table 6 where the relative ANGPTL expression in the table is below 0.25. In some embodiments, the sense strand sequence comprises or consists of an unmodified version of a sense strand sequence of any one of the siRNAs disclosed in Table 6. In some embodiments, the sense strand sequence comprises or consists of an siRNA with the sense strand sequence of a sense strand sequence of any one of the siRNAs disclosed in Table 6, but with one or more additional or different modifications, or with a different modification pattern. In some embodiments, the sense strand sequence lacks the sequence modifications, or has different or additional sequence modifications, but otherwise is similar to a sequence described herein.

In some embodiments, the sense strand sequence comprises or consists of a sense strand sequence of any one of the siRNAs disclosed in Table 7, or an siRNA thereof having 1 or 2 nucleoside substitutions, additions, or deletions. In some embodiments, the sense strand sequence comprises or consists of a sense strand sequence of any one of the siRNAs disclosed in Table 7. In some embodiments, the sense strand sequence comprises or consists of a sense strand sequence of any one of the siRNAs disclosed in Table 7 where the relative ANGPTL expression at 1 nM in the table is below 1, or an siRNA thereof having 1 or 2 nucleoside substitutions, additions, or deletions. In some embodiments, the sense strand sequence comprises or consists of a sense strand sequence of any one of the siRNAs disclosed in Table 7 where the relative ANGPTL expression at 1 nM in the table is below 1. In some embodiments, the sense strand sequence comprises or consists of a sense strand sequence of any one of the siRNAs disclosed in Table 7 where the relative ANGPTL expression at 1 nM of the siRNA in the table is below the expression of the negative control siRNA in the table (e.g. below a relative expression level of 0.66), or an siRNA thereof having 1 or 2 nucleoside substitutions, additions, or deletions. In some embodiments, the sense strand sequence comprises or consists of a sense strand sequence of any one of the siRNAs disclosed in Table 7 where the relative ANGPTL expression at 1 nM of the siRNA in the table is below the expression of the negative control siRNA in the table (e.g. below a relative expression level of 0.66). In some embodiments, the sense strand sequence comprises or consists of a sense strand sequence of any one of the siRNAs disclosed in Table 7 where the relative ANGPTL expression at 1 nM in the table is below 0.5, or an siRNA thereof having 1 or 2 nucleoside substitutions, additions, or deletions. In some embodiments, the sense strand sequence comprises or consists of a sense strand sequence of any one of the siRNAs disclosed in Table 7 where the relative ANGPTL expression at 1 nM in the table is below 0.5 (e.g. an siRNA with the sequence of ETD00245, ETD00247, or ETD00252). In some embodiments, the sense strand sequence comprises or consists of a sense strand sequence of any one of the siRNAs disclosed in Table 7 where the relative ANGPTL expression at 10 nM in the table is below 1, or an siRNA thereof having 1 or 2 nucleoside substitutions, additions, or deletions. In some embodiments, the sense strand sequence comprises or consists of a sense strand sequence of any one of the siRNAs disclosed in Table 7 where the relative ANGPTL expression at 10 nM in the table is below 1. In some embodiments, the sense strand sequence comprises or consists of an unmodified version of a sense strand sequence of any one of the siRNAs disclosed in Table 7. In some embodiments, the sense strand sequence comprises or consists of an siRNA with the sense strand sequence of a sense strand sequence of any one of the siRNAs disclosed in Table 7, but with one or more additional or different modifications, or with a different modification pattern. In some embodiments, the sense strand sequence lacks the sequence modifications, or has different or additional sequence modifications, but otherwise is similar to a sequence described herein.

In some embodiments, the sense strand sequence comprises or consists of a sense strand sequence of any one of the siRNAs disclosed in Table 8, or an siRNA thereof having 1 or 2 nucleoside substitutions, additions, or deletions. In some embodiments, the sense strand sequence comprises or consists of a sense strand sequence of any one of the siRNAs disclosed in Table 8. In some embodiments, the sense strand sequence comprises or consists of a sense strand sequence of any one of the siRNAs disclosed in Table 9, or an siRNA thereof having 1 or 2 nucleoside substitutions, additions, or deletions. In some embodiments, the sense strand sequence comprises or consists of a sense strand sequence of any one of the siRNAs disclosed in Table 9. In some embodiments, the sense strand sequence comprises or consists of a sense strand sequence of any one of the siRNAs disclosed in Table 10, or an siRNA thereof having 1 or 2 nucleoside substitutions, additions, or deletions. In some embodiments, the sense strand sequence comprises or consists of a sense strand sequence of any one of the siRNAs disclosed in Table 10. In some embodiments, the sense strand sequence lacks the sequence modifications, or has different or additional sequence modifications, but otherwise is similar to a sequence described herein.

In some embodiments, the sense strand sequence comprises or consists of a sense strand sequence of any one of the siRNAs disclosed in Table 11, or an siRNA thereof having 1 or 2 nucleoside substitutions, additions, or deletions. In some embodiments, the sense strand sequence comprises or consists of a sense strand sequence of any one of the siRNAs disclosed in Table 11. In some embodiments, the sense strand sequence comprises or consists of a sense strand sequence of any one of the siRNAs disclosed in Table 11 where the percent of the siRNA remaining at 4 hours in the table is at least 50%, or an siRNA thereof having 1 or 2 nucleoside substitutions, additions, or deletions. In some embodiments, the sense strand sequence comprises or consists of a sense strand sequence of any one of the siRNAs disclosed in Table 11 where the percent of the siRNA remaining at 4 hours in the table is at least 50%. In some embodiments, the sense strand sequence comprises or consists of a sense strand sequence of any one of the siRNAs disclosed in Table 11 where the percent of the siRNA remaining at 4 hours in the table is at least 75%, or an siRNA thereof having 1 or 2 nucleoside substitutions, additions, or deletions. In some embodiments, the sense strand sequence comprises or consists of a sense strand sequence of any one of the siRNAs disclosed in Table 11 where the percent of the siRNA remaining at 4 hours in the table is at least 75%. In some embodiments, the sense strand sequence comprises or consists of a sense strand sequence of any one of the siRNAs disclosed in Table 11 where the percent of the siRNA remaining at 24 hours in the table is at least 50%, or an siRNA thereof having 1 or 2 nucleoside substitutions, additions, or deletions. In some embodiments, the sense strand sequence comprises or consists of a sense strand sequence of any one of the siRNAs disclosed in Table 11 where the percent of the siRNA remaining at 24 hours in the table is at least 50%. In some embodiments, the sense strand sequence comprises or consists of a sense strand sequence of any one of the siRNAs disclosed in Table 11 where the percent of the siRNA remaining at 24 hours in the table is at least 75%, or an siRNA thereof having 1 or 2 nucleoside substitutions, additions, or deletions. In some embodiments, the sense strand sequence comprises or consists of a sense strand sequence of any one of the siRNAs disclosed in Table 11 where the percent of the siRNA remaining at 24 hours in the table is at least 75%. In some embodiments, the sense strand sequence comprises or consists of an unmodified version of a sense strand sequence of any one of the siRNAs disclosed in Table 11. In some embodiments, the sense strand sequence comprises or consists of an siRNA with the sense strand sequence of a sense strand sequence of any one of the siRNAs disclosed in Table 11, but with one or more additional or different modifications, or with a different modification pattern. In some embodiments, the sense strand sequence lacks the sequence modifications, or has different or additional sequence modifications, but otherwise is similar to a sequence described herein.

In some embodiments, the sense strand sequence comprises or consists of a sense strand sequence of any one of the siRNAs disclosed in Table 12, or an siRNA thereof having 1 or 2 nucleoside substitutions, additions, or deletions. In some embodiments, the sense strand sequence comprises or consists of a sense strand sequence of any one of the siRNAs disclosed in Table 12. In some embodiments, the sense strand sequence comprises or consists of a sense strand sequence of any one of the siRNAs disclosed in Table 13, or an siRNA thereof having 1 or 2 nucleoside substitutions, additions, or deletions. In some embodiments, the sense strand sequence comprises or consists of a sense strand sequence of any one of the siRNAs disclosed in Table 13. In some embodiments, the sense strand sequence lacks the sequence modifications, or has different or additional sequence modifications, but otherwise is similar to a sequence described herein.

In some embodiments, the sense strand sequence comprises or consists of the sequence of the sense strand of siRNA ETD00269, or an siRNA thereof having 1 or 2 nucleoside substitutions, additions, or deletions. In some embodiments, the sense strand sequence comprises or consists of the sequence of the sense strand of siRNA ETD00269. In some embodiments, the sense strand sequence comprises or consists of the sequence of the sense strand of siRNA ETD00270, or an siRNA thereof having 1 or 2 nucleoside substitutions, additions, or deletions. In some embodiments, the sense strand sequence comprises or consists of the sequence of the sense strand of siRNA ETD00270. In some embodiments, the sense strand sequence comprises or consists of the sequence of the sense strand of siRNA ETD00353, or an siRNA thereof having 1 or 2 nucleoside substitutions, additions, or deletions. In some embodiments, the sense strand sequence comprises or consists of the sequence of the sense strand of siRNA ETD00353. In some embodiments, the sense strand sequence comprises or consists of the sequence of the sense strand of siRNA ETD00356, or an siRNA thereof having 1 or 2 nucleoside substitutions, additions, or deletions. In some embodiments, the sense strand sequence comprises or consists of the sequence of the sense strand of siRNA ETD00356. In some embodiments, the sense strand sequence comprises or consists of the sequence of the sense strand of siRNA ETD00358, or an siRNA thereof having 1 or 2 nucleoside substitutions, additions, or deletions. In some embodiments, the sense strand sequence comprises or consists of the sequence of the sense strand of siRNA ETD00358. In some embodiments, the sense strand sequence comprises or consists of the sequence of the sense strand of siRNA ETD00370, or an siRNA thereof having 1 or 2 nucleoside substitutions, additions, or deletions. In some embodiments, the sense strand sequence comprises or consists of the sequence of the sense strand of siRNA ETD00370. In some embodiments, the sense strand sequence comprises or consists of the sequence of the sense strand of siRNA ETD00377, or an siRNA thereof having 1 or 2 nucleoside substitutions, additions, or deletions. In some embodiments, the sense strand sequence comprises or consists of the sequence of the sense strand of siRNA ETD00377. In some embodiments, the sense strand sequence comprises or consists of the sequence of the sense strand of siRNA ETD00378, or an siRNA thereof having 1 or 2 nucleoside substitutions, additions, or deletions. In some embodiments, the sense strand sequence comprises or consists of the sequence of the sense strand of siRNA ETD00378. In some embodiments, the sense strand sequence comprises or consists of the sequence of the sense strand of siRNA ETD00382, or an siRNA thereof having 1 or 2 nucleoside substitutions, additions, or deletions. In some embodiments, the sense strand sequence comprises or consists of the sequence of the sense strand of siRNA ETD00382. In some embodiments, the sense strand sequence comprises or consists of the sequence of SEQ ID NO: 11377, or an siRNA thereof having 1 or 2 nucleoside substitutions, additions, or deletions. In some embodiments, the sense strand sequence comprises or consists of the sequence of SEQ ID NO: 11377. In some embodiments, the sense strand sequence comprises or consists of the sequence of SEQ ID NO: 11378, or an siRNA thereof having 1 or 2 nucleoside substitutions, additions, or deletions. In some embodiments, the sense strand sequence comprises or consists of the sequence of SEQ ID NO: 11387. In some embodiments, the sense strand sequence lacks the sequence modifications, or has different or additional sequence modifications, but otherwise is similar to a sequence described herein.

In some embodiments, the antisense strand comprises a antisense strand sequence with one or more modifications or modification patterns. In some embodiments, the antisense strand sequence comprises or consists of sequence at least 75% identical to of any one of SEQ ID NOs: 11093-11212, at least 80% identical to of any one of SEQ ID NOs: 11093-11212, at least 85% identical to of any one of SEQ ID NOs: 11093-11212, at least 90% identical to of any one of SEQ ID NOs: 11093-11212, or at least 95% identical to of any one of SEQ ID NOs: 11093-11212. In some embodiments, the antisense strand sequence comprises or consists of the sequence of any one of SEQ ID NOs: 11093-11212, or a sequence thereof having 1, 2, 3, or 4 nucleoside substitutions, additions, or deletions. In some embodiments, the antisense strand sequence comprises or consists of the sequence of any one of SEQ ID NOs: 11093-11212, or a sequence thereof having 1 or 2 nucleoside substitutions, additions, or deletions. In some embodiments, the antisense strand sequence comprises or consists of the sequence of any one of SEQ ID NOs: 11093-11212. In some embodiments, the antisense strand sequence is an unmodified version of a antisense strand sequence described herein. In some embodiments, the antisense strand sequence has more or different sequence modifications than a antisense strand sequence described herein.

In some embodiments, the antisense strand sequence comprises or consists of sequence at least 75% identical to of any one of SEQ ID NOs: 11333-11354, at least 80% identical to of any one of SEQ ID NOs: 11333-11354, at least 85% identical to of any one of SEQ ID NOs: 11333-11354, at least 90% identical to of any one of SEQ ID NOs: 11333-11354, or at least 95% identical to of any one of SEQ ID NOs: 11333-11354. In some embodiments, the antisense strand sequence comprises or consists of the sequence of any one of SEQ ID NOs: 11333-11354, or a sequence thereof having 1, 2, 3, or 4 nucleoside substitutions, additions, or deletions. In some embodiments, the antisense strand sequence comprises or consists of the sequence of any one of SEQ ID NOs: 11333-11354, or a sequence thereof having 1 or 2 nucleoside substitutions, additions, or deletions. In some embodiments, the antisense strand sequence comprises or consists of the sequence of any one of SEQ ID NOs: 11333-11354. In some embodiments, the antisense strand sequence lacks the sequence modifications, or has different or additional sequence modifications, but otherwise is similar to a sequence described herein.

In some embodiments, the antisense strand sequence comprises or consists of a antisense strand sequence of a antisense strand sequence of any one of the siRNAs disclosed in any of Tables 5-13, or an siRNA thereof having 1 or 2 nucleoside substitutions, additions, or deletions. In some embodiments, the antisense strand sequence comprises or consists of a antisense strand sequence of a antisense strand sequence of any one of the siRNAs disclosed in any of Tables 5-13. In some embodiments, the antisense strand sequence comprises or consists of a sequence at least 75% identical, at least 80% identical, at least 85% identical, at least 90% identical, or at least 95% identical to a antisense strand sequence of an siRNA in any of Tables 5-13.

In some embodiments, the antisense strand sequence comprises or consists of a antisense strand sequence of a antisense strand sequence of any one of the siRNAs disclosed in any of Tables 5-10, or an siRNA thereof having 1 or 2 nucleoside substitutions, additions, or deletions. In some embodiments, the antisense strand sequence comprises or consists of a antisense strand sequence of any one of the siRNAs disclosed in any of Tables 5-10. In some embodiments, the antisense strand sequence comprises or consists of a antisense strand sequence of any one of the siRNAs disclosed in any of Tables 5-10 where a relative ANGPTL expression in the table is below 1, or an siRNA thereof having 1 or 2 nucleoside substitutions, additions, or deletions. In some embodiments, the antisense strand sequence comprises or consists of a antisense strand sequence of any one of the siRNAs disclosed in any of Tables 5-10 where a relative ANGPTL expression in the table is below 1. In some embodiments, the antisense strand sequence comprises or consists of a antisense strand sequence of any one of the siRNAs disclosed in any of Tables 5-10 where a relative ANGPTL expression of the siRNA in the table is below the expression of a negative control in the table, or an siRNA thereof having 1 or 2 nucleoside substitutions, additions, or deletions. In some embodiments, the antisense strand sequence comprises or consists of a antisense strand sequence of any one of the siRNAs disclosed in any of Tables 5-10 where a relative ANGPTL expression of the siRNA in the table is below the expression of a negative control in the table. In some embodiments, the antisense strand sequence comprises or consists of a antisense strand sequence of any one of the siRNAs disclosed in any of Tables 5-10 where a relative ANGPTL expression in the table is below 0.5, or an siRNA thereof having 1 or 2 nucleoside substitutions, additions, or deletions. In some embodiments, the antisense strand sequence comprises or consists of a antisense strand sequence of any one of the siRNAs disclosed in any of Tables 5-10 where a relative ANGPTL expression in the table is below 0.5. In some embodiments, the antisense strand sequence comprises or consists of a antisense strand sequence of any one of the siRNAs disclosed in any of Tables 5-10 where a relative ANGPTL expression in the table is below 0.25, or an siRNA thereof having 1 or 2 nucleoside substitutions, additions, or deletions. In some embodiments, the antisense strand sequence comprises or consists of a antisense strand sequence of any one of the siRNAs disclosed in any of Tables 5-10 where a relative ANGPTL expression in the table is below 0.25. In some embodiments, the antisense strand sequence comprises or consists of an unmodified version of a antisense strand sequence of any one of the siRNAs disclosed in any of Tables 5-10. In some embodiments, the antisense strand sequence comprises or consists of an siRNA with the antisense strand sequence of a antisense strand sequence of any one of the siRNAs disclosed in any of Tables 5-10, but with one or more additional or different modifications, or with a different modification pattern. In some embodiments, the antisense strand sequence lacks the sequence modifications, or has different or additional sequence modifications, but otherwise is similar to a sequence described herein.

In some embodiments, the antisense strand sequence comprises or consists of a antisense strand sequence of any one of the siRNAs disclosed in Table 5, or an siRNA thereof having 1 or 2 nucleoside substitutions, additions, or deletions. In some embodiments, the antisense strand sequence comprises or consists of a antisense strand sequence of any one of the siRNAs disclosed in Table 5. In some embodiments, the antisense strand sequence comprises or consists of a antisense strand sequence of any one of the siRNAs disclosed in Table 5 where the relative ANGPTL expression in the table is below 1, or an siRNA thereof having 1 or 2 nucleoside substitutions, additions, or deletions. In some embodiments, the antisense strand sequence comprises or consists of a antisense strand sequence of any one of the siRNAs disclosed in Table 5 where the relative ANGPTL expression in the table is below 1. In some embodiments, the antisense strand sequence comprises or consists of a antisense strand sequence of any one of the siRNAs disclosed in Table 5 where the relative ANGPTL expression of the siRNA in the table is below the expression of the negative control siRNA in the table (e.g. below a relative expression level of 0.67), or an siRNA thereof having 1 or 2 nucleoside substitutions, additions, or deletions. In some embodiments, the antisense strand sequence comprises or consists of a antisense strand sequence of any one of the siRNAs disclosed in Table 5 where the relative ANGPTL expression of the siRNA in the table is below the expression of the negative control siRNA in the table (e.g. below a relative expression level of 0.67). In some embodiments, the antisense strand sequence comprises or consists of a antisense strand sequence of any one of the siRNAs disclosed in Table 5 where the relative ANGPTL expression in the table is below 0.5, or an siRNA thereof having 1 or 2 nucleoside substitutions, additions, or deletions. In some embodiments, the antisense strand sequence comprises or consists of a antisense strand sequence of any one of the siRNAs disclosed in Table 5 where the relative ANGPTL expression in the table is below 0.5. In some embodiments, the antisense strand sequence comprises or consists of a antisense strand sequence of any one of the siRNAs disclosed in Table 5 where the relative ANGPTL expression in the table is below 0.25, or an siRNA thereof having 1 or 2 nucleoside substitutions, additions, or deletions. In some embodiments, the antisense strand sequence comprises or consists of a antisense strand sequence of any one of the siRNAs disclosed in Table 5 where the relative ANGPTL expression in the table is below 0.25. In some embodiments, the antisense strand sequence comprises or consists of an unmodified version of a antisense strand sequence of any one of the siRNAs disclosed in Table 5. In some embodiments, the antisense strand sequence comprises or consists of an siRNA with the antisense strand sequence of a antisense strand sequence of any one of the siRNAs disclosed in Table 5, but with one or more additional or different modifications, or with a different modification pattern. In some embodiments, the antisense strand sequence lacks the sequence modifications, or has different or additional sequence modifications, but otherwise is similar to a sequence described herein.

In some embodiments, the antisense strand sequence is incorporated into an siRNA that downregulates ANGPTL7. In some embodiments, the antisense strand sequence comprises or consists of a antisense strand sequence of any one of SEQ ID NOs: 11214, 11215, 11216, 11217, 11218, 11219, 11220, 11221, 11222, 11223, 11224, 11225, 11226, 11229, 11230, 11233, 11236, 11238, 11239, 11241, 11242, 11243, 11244, 11245, 11246, 11247, 11248, 11249, 11250, 11252, 11253, 11254, 11255, 11256, 11259, 11260, 11263, 11264, 11265, 11266, 11267, 11268, 11269, 11270, 11271, 11272, 11273, 11274, 11275, 11276, 11277, 11278, 11279, 11280, 11281, 11282, 11283, 11284, 11285, 11286, 11287, 11288, 11289, 11290, 11291, 11292, 11293, 11294, 11295, 11296, 11297, 11298, 11300, 11301, 11302, 11303, 11304, 11305, 11306, 11307, 11308, 11309, 11311, 11313, 11315, 11316, 11318, 11319, 11320, 11321, 11323, 11324, 11325, 11327, 11328, 11330, 11331, or 11332, or an siRNA thereof having 1 or 2 nucleoside substitutions, additions, or deletions. In some embodiments, the antisense strand sequence comprises or consists of a antisense strand sequence of any one of SEQ ID NOs: 11214, 11215, 11216, 11217, 11218, 11219, 11220, 11221, 11222, 11223, 11224, 11225, 11226, 11229, 11230, 11233, 11236, 11238, 11239, 11241, 11242, 11243, 11244, 11245, 11246, 11247, 11248, 11249, 11250, 11252, 11253, 11254, 11255, 11256, 11259, 11260, 11263, 11264, 11265, 11266, 11267, 11268, 11269, 11270, 11271, 11272, 11273, 11274, 11275, 11276, 11277, 11278, 11279, 11280, 11281, 11282, 11283, 11284, 11285, 11286, 11287, 11288, 11289, 11290, 11291, 11292, 11293, 11294, 11295, 11296, 11297, 11298, 11300, 11301, 11302, 11303, 11304, 11305, 11306, 11307, 11308, 11309, 11311, 11313, 11315, 11316, 11318, 11319, 11320, 11321, 11323, 11324, 11325, 11327, 11328, 11330, 11331, or 11332.

In some embodiments, the antisense strand sequence comprises or consists of a antisense strand sequence of any one of the siRNAs disclosed in Table 6, or an siRNA thereof having 1 or 2 nucleoside substitutions, additions, or deletions. In some embodiments, the antisense strand sequence comprises or consists of a antisense strand sequence of any one of the siRNAs disclosed in Table 6. In some embodiments, the antisense strand sequence comprises or consists of a antisense strand sequence of any one of the siRNAs disclosed in Table 6 where the relative ANGPTL expression in the table is below 1, or an siRNA thereof having 1 or 2 nucleoside substitutions, additions, or deletions. In some embodiments, the antisense strand sequence comprises or consists of a antisense strand sequence of any one of the siRNAs disclosed in Table 6 where the relative ANGPTL expression in the table is below 1. In some embodiments, the antisense strand sequence comprises or consists of a antisense strand sequence of any one of the siRNAs disclosed in Table 6 where the relative ANGPTL expression of the siRNA in the table is below the expression of the negative control siRNA in the table (e.g. below a relative expression level of 1.06), or an siRNA thereof having 1 or 2 nucleoside substitutions, additions, or deletions. In some embodiments, the antisense strand sequence comprises or consists of a antisense strand sequence of any one of the siRNAs disclosed in Table 6 where the relative ANGPTL expression of the siRNA in the table is below the expression of the negative control siRNA in the table (e.g. below a relative expression level of 1.06). In some embodiments, the antisense strand sequence comprises or consists of a antisense strand sequence of any one of the siRNAs disclosed in Table 6 where the relative ANGPTL expression in the table is below 0.5, or an siRNA thereof having 1 or 2 nucleoside substitutions, additions, or deletions. In some embodiments, the antisense strand sequence comprises or consists of a antisense strand sequence of any one of the siRNAs disclosed in Table 6 where the relative ANGPTL expression in the table is below 0.5. In some embodiments, the antisense strand sequence comprises or consists of a antisense strand sequence of any one of the siRNAs disclosed in Table 6 where the relative ANGPTL expression in the table is below 0.25, or an siRNA thereof having 1 or 2 nucleoside substitutions, additions, or deletions. In some embodiments, the antisense strand sequence comprises or consists of a antisense strand sequence of any one of the siRNAs disclosed in Table 6 where the relative ANGPTL expression in the table is below 0.25. In some embodiments, the antisense strand sequence comprises or consists of an unmodified version of a antisense strand sequence of any one of the siRNAs disclosed in Table 6. In some embodiments, the antisense strand sequence comprises or consists of an siRNA with the antisense strand sequence of a antisense strand sequence of any one of the siRNAs disclosed in Table 6, but with one or more additional or different modifications, or with a different modification pattern. In some embodiments, the antisense strand sequence lacks the sequence modifications, or has different or additional sequence modifications, but otherwise is similar to a sequence described herein.

In some embodiments, the antisense strand sequence comprises or consists of a antisense strand sequence of any one of the siRNAs disclosed in Table 7, or an siRNA thereof having 1 or 2 nucleoside substitutions, additions, or deletions. In some embodiments, the antisense strand sequence comprises or consists of a antisense strand sequence of any one of the siRNAs disclosed in Table 7. In some embodiments, the antisense strand sequence comprises or consists of a antisense strand sequence of any one of the siRNAs disclosed in Table 7 where the relative ANGPTL expression at 1 nM in the table is below 1, or an siRNA thereof having 1 or 2 nucleoside substitutions, additions, or deletions. In some embodiments, the antisense strand sequence comprises or consists of a antisense strand sequence of any one of the siRNAs disclosed in Table 7 where the relative ANGPTL expression at 1 nM in the table is below 1. In some embodiments, the antisense strand sequence comprises or consists of a antisense strand sequence of any one of the siRNAs disclosed in Table 7 where the relative ANGPTL expression at 1 nM of the siRNA in the table is below the expression of the negative control siRNA in the table (e.g. below a relative expression level of 0.66), or an siRNA thereof having 1 or 2 nucleoside substitutions, additions, or deletions. In some embodiments, the antisense strand sequence comprises or consists of a antisense strand sequence of any one of the siRNAs disclosed in Table 7 where the relative ANGPTL expression at 1 nM of the siRNA in the table is below the expression of the negative control siRNA in the table (e.g. below a relative expression level of 0.66). In some embodiments, the antisense strand sequence comprises or consists of a antisense strand sequence of any one of the siRNAs disclosed in Table 7 where the relative ANGPTL expression at 1 nM in the table is below 0.5, or an siRNA thereof having 1 or 2 nucleoside substitutions, additions, or deletions. In some embodiments, the antisense strand sequence comprises or consists of a antisense strand sequence of any one of the siRNAs disclosed in Table 7 where the relative ANGPTL expression at 1 nM in the table is below 0.5 (e.g. an siRNA with the sequence of ETD00245, ETD00247, or ETD00252). In some embodiments, the antisense strand sequence comprises or consists of a antisense strand sequence of any one of the siRNAs disclosed in Table 7 where the relative ANGPTL expression at 10 nM in the table is below 1, or an siRNA thereof having 1 or 2 nucleoside substitutions, additions, or deletions. In some embodiments, the antisense strand sequence comprises or consists of a antisense strand sequence of any one of the siRNAs disclosed in Table 7 where the relative ANGPTL expression at 10 nM in the table is below 1. In some embodiments, the antisense strand sequence comprises or consists of an unmodified version of a antisense strand sequence of any one of the siRNAs disclosed in Table 7. In some embodiments, the antisense strand sequence comprises or consists of an siRNA with the antisense strand sequence of a antisense strand sequence of any one of the siRNAs disclosed in Table 7, but with one or more additional or different modifications, or with a different modification pattern. In some embodiments, the antisense strand sequence lacks the sequence modifications, or has different or additional sequence modifications, but otherwise is similar to a sequence described herein.

In some embodiments, the antisense strand sequence comprises or consists of a antisense strand sequence of any one of the siRNAs disclosed in Table 8, or an siRNA thereof having 1 or 2 nucleoside substitutions, additions, or deletions. In some embodiments, the antisense strand sequence comprises or consists of a antisense strand sequence of any one of the siRNAs disclosed in Table 8. In some embodiments, the antisense strand sequence comprises or consists of a antisense strand sequence of any one of the siRNAs disclosed in Table 9, or an siRNA thereof having 1 or 2 nucleoside substitutions, additions, or deletions. In some embodiments, the antisense strand sequence comprises or consists of a antisense strand sequence of any one of the siRNAs disclosed in Table 9. In some embodiments, the antisense strand sequence comprises or consists of a antisense strand sequence of any one of the siRNAs disclosed in Table 10, or an siRNA thereof having 1 or 2 nucleoside substitutions, additions, or deletions. In some embodiments, the antisense strand sequence comprises or consists of a antisense strand sequence of any one of the siRNAs disclosed in Table 10. In some embodiments, the antisense strand sequence lacks the sequence modifications, or has different or additional sequence modifications, but otherwise is similar to a sequence described herein.

In some embodiments, the antisense strand sequence comprises or consists of a antisense strand sequence of any one of the siRNAs disclosed in Table 11, or an siRNA thereof having 1 or 2 nucleoside substitutions, additions, or deletions. In some embodiments, the antisense strand sequence comprises or consists of a antisense strand sequence of any one of the siRNAs disclosed in Table 11. In some embodiments, the antisense strand sequence comprises or consists of a antisense strand sequence of any one of the siRNAs disclosed in Table 11 where the percent of the siRNA remaining at 4 hours in the table is at least 50%, or an siRNA thereof having 1 or 2 nucleoside substitutions, additions, or deletions. In some embodiments, the antisense strand sequence comprises or consists of a antisense strand sequence of any one of the siRNAs disclosed in Table 11 where the percent of the siRNA remaining at 4 hours in the table is at least 50%. In some embodiments, the antisense strand sequence comprises or consists of a antisense strand sequence of any one of the siRNAs disclosed in Table 11 where the percent of the siRNA remaining at 4 hours in the table is at least 75%, or an siRNA thereof having 1 or 2 nucleoside substitutions, additions, or deletions. In some embodiments, the antisense strand sequence comprises or consists of a antisense strand sequence of any one of the siRNAs disclosed in Table 11 where the percent of the siRNA remaining at 4 hours in the table is at least 75%. In some embodiments, the antisense strand sequence comprises or consists of a antisense strand sequence of any one of the siRNAs disclosed in Table 11 where the percent of the siRNA remaining at 24 hours in the table is at least 50%, or an siRNA thereof having 1 or 2 nucleoside substitutions, additions, or deletions. In some embodiments, the antisense strand sequence comprises or consists of a antisense strand sequence of any one of the siRNAs disclosed in Table 11 where the percent of the siRNA remaining at 24 hours in the table is at least 50%. In some embodiments, the antisense strand sequence comprises or consists of a antisense strand sequence of any one of the siRNAs disclosed in Table 11 where the percent of the siRNA remaining at 24 hours in the table is at least 75%, or an siRNA thereof having 1 or 2 nucleoside substitutions, additions, or deletions. In some embodiments, the antisense strand sequence comprises or consists of a antisense strand sequence of any one of the siRNAs disclosed in Table 11 where the percent of the siRNA remaining at 24 hours in the table is at least 75%. In some embodiments, the antisense strand sequence comprises or consists of an unmodified version of a antisense strand sequence of any one of the siRNAs disclosed in Table 11. In some embodiments, the antisense strand sequence comprises or consists of an siRNA with the antisense strand sequence of a antisense strand sequence of any one of the siRNAs disclosed in Table 11, but with one or more additional or different modifications, or with a different modification pattern. In some embodiments, the antisense strand sequence lacks the sequence modifications, or has different or additional sequence modifications, but otherwise is similar to a sequence described herein.

In some embodiments, the antisense strand sequence comprises or consists of a antisense strand sequence of any one of the siRNAs disclosed in Table 12, or an siRNA thereof having 1 or 2 nucleoside substitutions, additions, or deletions. In some embodiments, the antisense strand sequence comprises or consists of a antisense strand sequence of any one of the siRNAs disclosed in Table 12. In some embodiments, the antisense strand sequence comprises or consists of a antisense strand sequence of any one of the siRNAs disclosed in Table 13, or an siRNA thereof having 1 or 2 nucleoside substitutions, additions, or deletions. In some embodiments, the antisense strand sequence comprises or consists of a antisense strand sequence of any one of the siRNAs disclosed in Table 13. In some embodiments, the antisense strand sequence lacks the sequence modifications, or has different or additional sequence modifications, but otherwise is similar to a sequence described herein.

In some embodiments, the antisense strand sequence comprises or consists of the sequence of the antisense strand of siRNA ETD00269, or an siRNA thereof having 1 or 2 nucleoside substitutions, additions, or deletions. In some embodiments, the antisense strand sequence comprises or consists of the sequence of the antisense strand of siRNA ETD00269. In some embodiments, the antisense strand sequence comprises or consists of the sequence of the antisense strand of siRNA ETD00270, or an siRNA thereof having 1 or 2 nucleoside substitutions, additions, or deletions. In some embodiments, the antisense strand sequence comprises or consists of the sequence of the antisense strand of siRNA ETD00270. In some embodiments, the antisense strand sequence comprises or consists of the sequence of the antisense strand of siRNA ETD00353, or an siRNA thereof having 1 or 2 nucleoside substitutions, additions, or deletions. In some embodiments, the antisense strand sequence comprises or consists of the sequence of the antisense strand of siRNA ETD00353. In some embodiments, the antisense strand sequence comprises or consists of the sequence of the antisense strand of siRNA ETD00356, or an siRNA thereof having 1 or 2 nucleoside substitutions, additions, or deletions. In some embodiments, the antisense strand sequence comprises or consists of the sequence of the antisense strand of siRNA ETD00356. In some embodiments, the antisense strand sequence comprises or consists of the sequence of the antisense strand of siRNA ETD00358, or an siRNA thereof having 1 or 2 nucleoside substitutions, additions, or deletions. In some embodiments, the antisense strand sequence comprises or consists of the sequence of the antisense strand of siRNA ETD00358. In some embodiments, the antisense strand sequence comprises or consists of the sequence of the antisense strand of siRNA ETD00370, or an siRNA thereof having 1 or 2 nucleoside substitutions, additions, or deletions. In some embodiments, the antisense strand sequence comprises or consists of the sequence of the antisense strand of siRNA ETD00370. In some embodiments, the antisense strand sequence comprises or consists of the sequence of the antisense strand of siRNA ETD00377, or an siRNA thereof having 1 or 2 nucleoside substitutions, additions, or deletions. In some embodiments, the antisense strand sequence comprises or consists of the sequence of the antisense strand of siRNA ETD00377. In some embodiments, the antisense strand sequence comprises or consists of the sequence of the antisense strand of siRNA ETD00378, or an siRNA thereof having 1 or 2 nucleoside substitutions, additions, or deletions. In some embodiments, the antisense strand sequence comprises or consists of the sequence of the antisense strand of siRNA ETD00378. In some embodiments, the antisense strand sequence comprises or consists of the sequence of the antisense strand of siRNA ETD00382, or an siRNA thereof having 1 or 2 nucleoside substitutions, additions, or deletions. In some embodiments, the antisense strand sequence comprises or consists of the sequence of the antisense strand of siRNA ETD00382. In some embodiments, the antisense strand sequence comprises or consists of the sequence of the antisense strand of siRNA ETD00752, or an siRNA thereof having 1 or 2 nucleoside substitutions, additions, or deletions. In some embodiments, the antisense strand sequence comprises or consists of the sequence of the antisense strand of siRNA ETD00752. In some embodiments, the antisense strand sequence comprises or consists of the sequence of SEQ ID NO: 11379, or an siRNA thereof having 1 or 2 nucleoside substitutions, additions, or deletions. In some embodiments, the antisense strand sequence comprises or consists of the sequence of SEQ ID NO: 11379. In some embodiments, the antisense strand sequence lacks the sequence modifications, or has different or additional sequence modifications, but otherwise is similar to a sequence described herein.

Antisense Compounds

In one aspect, provided herein is an antisense compound or oligonucleotide for modulating the activity and/or expression of a target nucleic acid, e.g., ANGPTL7. In some embodiments, the antisense compound inhibits expression of ANGPTL7. In some cases, the antisense compound comprises a sequence at least about 80%, 85%, 90%, 95%, or 100% identical to a sequence selected from SEQ ID NOS: 4413-11084. In some cases, the antisense compound comprises a sequence at least about 80%, 85%, 90%, 95%, or 100% identical to SEQ ID NO: 11087.

In some embodiments, the antisense compound is specifically hybridizable to the target nucleic acid, where binding of the compound to the target nucleic acid interferes with the normal function of the target nucleic acid to cause, e.g., a loss of activity, and there is a sufficient degree of complementarity to avoid non-specific binding of the antisense compound to non-target nucleic acid sequences under conditions in which specific binding is desired. Such conditions include physiological conditions in the case of in vivo assays or therapeutic treatment, and conditions in which assays are performed in the case of in vitro assays.

In some embodiments, the antisense compounds include variants in which a different base is present at one or more of the nucleotide positions in the compound. For example, if the first nucleotide is an adenine, variants may be produced which contain thymidine, guanosine, cytidine or other natural or unnatural nucleotides at this position. This may be done at any of the positions of the antisense compound. These compounds are then tested using the methods described herein to determine their ability to inhibit expression of a target nucleic acid.

In some embodiments, homology, sequence identity or complementarity, between the antisense compound and target is from about 50% to about 60%. In some embodiments, homology, sequence identity or complementarity, is from about 60% to about 70%. In some embodiments, homology, sequence identity or complementarity, is from about 70% to about 80%. In some embodiments, homology, sequence identity or complementarity, is from about 80% to about 90%. In some embodiments, homology, sequence identity or complementarity, is about 90%, about 92%, about 94%, about 95%, about 96%, about 97%, about 98%, about 99% or about 100%.

In some embodiments, an antisense compound, whether DNA, RNA, chimeric, substituted etc, is specifically hybridizable when binding of the compound to the target DNA or RNA molecule interferes with the normal function of the target DNA or RNA, e.g., to cause a loss of utility, and there is a sufficient degree of complementarily to avoid non-specific binding of the antisense compound to non-target sequences under conditions in which specific binding is desired, i.e., under physiological conditions in the case of in vivo assays or therapeutic treatment, and in the case of in vitro assays, under conditions in which the assays are performed.

In some embodiments, targeting of ANGPTL7 includes without limitation, antisense sequences which are identified and expanded, using for example, PCR, hybridization etc., one or more of the sequences set forth as SEQ ID NOS: 4413-11084, and the like (e.g., oligonucleotides having at least about 80%, 85%, 90%, 95%, or 100% identity to a sequence selected from SEQ ID NOS: 4413-11084), to modulate the expression or function of ANGPTL7. In some embodiments, expression or function is down-regulated as compared to a control oligonucleotide that does not specifically hybridize to ANGPTL7.

In some embodiments, an antisense oligonucleotide comprises one or more modified nucleotides, shorter or longer fragments, modified bonds and the like. Examples of modified bonds or internucleotide linkages comprise phosphorothioate, phosphorodithioate or the like. In some embodiments, the nucleotides comprise a phosphorus derivative. The phosphorus derivative (or modified phosphate group) which may be attached to the sugar or sugar analog moiety in the modified oligonucleotides may be a monophosphate, diphosphate, triphosphate, alkylphosphate, alkanephosphate, phosphorothioate and the like.

In embodiments, oligomeric antisense compounds, particularly oligonucleotides, bind to target nucleic acid molecules and modulate the expression and/or function of molecules encoded by a target gene. The functions of DNA to be interfered comprise, for example, replication and transcription. The functions of RNA to be interfered comprise all vital functions such as, for example, translocation of the RNA to the site of protein translation, translation of protein from the RNA, splicing of the RNA to yield one or more mRNA species, and catalytic activity which may be engaged in or facilitated by the RNA. The functions may be up-regulated or inhibited depending on the functions desired.

The antisense compounds, include antisense oligomeric compounds, antisense oligonucleotides, external guide sequence (EGS) oligonucleotides, alternate splicers, primers, probes, and other oligomeric compounds that hybridize to at least a portion of the target nucleic acid. As such, these compounds may be introduced in the form of single-stranded, double-stranded, partially single-stranded, or circular oligomeric compounds.

Targeting an antisense compound to a particular nucleic acid molecule can be a multistep process. The process may begin with the identification of a target nucleic acid whose function is to be modulated. This target nucleic acid may be, for example, a cellular gene (or mRNA transcribed from the gene) whose expression is associated with a particular disorder or disease state. In some embodiments, the target nucleic acid encodes angiopoietin like 7 (ANGPTL7).

The targeting process may include determination of at least one target region, segment, or site within the target nucleic acid for the antisense interaction to occur such that the desired effect, e.g., modulation of expression, will result. In some embodiments, the term "region" is defined as a portion of the target nucleic acid having at least one identifiable structure, function, or characteristic. Within regions of target nucleic acids are segments. "Segments" may be defined as smaller or sub-portions of regions within a target nucleic acid. "Sites" may be defined as positions within a target nucleic acid.

In some embodiments, the antisense oligonucleotides bind to the natural antisense sequences of angiopoietin like 7 (ANGPTL7) and modulate the expression and/or function of ANGPTL7 (SEQ ID NO: 11085).

In some embodiments, the antisense oligonucleotides bind to one or more segments of angiopoietin like 7 (ANGPTL7) polynucleotides and modulate the expression and/or function of ANGPTL7. In some cases, the segments comprise at least five consecutive nucleotides of the ANGPTL7 sense or antisense polynucleotides.

Since the translation initiation codon is typically 5'-AUG (in transcribed mRNA molecules; 5-ATG in the corresponding DNA molecule), the translation initiation codon may be referred to as the "AUG codon," the "start codon" or the "AUG start codon". A minority of genes has a translation initiation codon having the RNA sequence 5'-GUG, 5'-UUG or 5'-CUG; and 5'-AUA, 5'-ACG and 5'-CUG have been shown to function in vivo. Thus, in some cases, the terms "translation initiation codon" and "start codon" can encompass many codon sequences, even though the initiator amino acid in each instance is typically methionine (in eukaryotes) or formylmethionine (in prokaryotes). Eukaryotic and prokaryotic genes may have two or more alternative start codons, any one of which may be preferentially utilized for translation initiation in a particular cell type or tissue, or under a particular set of conditions. In some embodiments, "start codon" and "translation initiation codon" refer to the codon or codons that are used in vivo to initiate translation of an mRNA transcribed from a gene encoding angiopoietin like 7, (ANGPTL7), regardless of the sequence(s) of such codons. In some cases, a translation termination codon (or "stop codon") of a gene may have one of three sequences, i.e., 5'-UAA, 5'-UAG and 5'-UGA (the corresponding DNA sequences are 5'-TAA, 5'-TAG and 5'-TGA, respectively).

In some embodiments, the terms "start codon region" and "translation initiation codon region" refer to a portion of such an mRNA or gene that encompasses from about 25 to about 50 contiguous nucleotides in either direction (i.e., 5' or 3') from a translation initiation codon. In some cases, the terms "stop codon region" and "translation termination codon region" refer to a portion of such an mRNA or gene that encompasses from about 25 to about 50 contiguous nucleotides in either direction (i.e., 5' or 3') from a translation termination codon. Consequently, the "start codon region" (or "translation initiation codon region") and the "stop codon region" (or "translation termination codon region") are all regions that may be targeted effectively with the antisense compounds described herein.

The open reading frame (ORF) or "coding region," which refers to the region between the translation initiation codon and the translation termination codon, is also a region which may be targeted effectively. In some embodiments, a targeted region is the intragenic region encompassing the translation initiation or termination codon of the open reading frame (ORF) of a gene.

Another target region includes the 5' untranslated region (5'-UTR), which refers to the portion of an mRNA in the 5' direction from the translation initiation codon, and thus including nucleotides between the 5' cap site and the translation initiation codon of an mRNA (or corresponding nucleotides on the gene). Still another target region includes the 3' untranslated region (3'-UTR), which refers to the portion of an mRNA in the 3' direction from the translation termination codon, and thus including nucleotides between the translation termination codon and 3' end of an mRNA (or corresponding nucleotides on the gene). The 5' cap site of an mRNA comprises an N7-methylated guanosine residue joined to the 5-most residue of the mRNA via a 5-5' triphosphate linkage. The 5' cap region of an mRNA is considered to include the 5' cap structure itself as well as the first 50 nucleotides adjacent to the cap site. Another target region is the 5' cap region.

Although some eukaryotic mRNA transcripts are directly translated, many contain one or more regions, known as "introns," which are excised from a transcript before it is translated. The remaining (and therefore translated) regions are known as "exons" and are spliced together to form a continuous mRNA sequence. In some embodiments, targeting splice sites, i.e., intron-exonjunctions or exon-intron junctions, is particularly useful in situations where aberrant splicing is implicated in disease, or where an overproduction of a particular splice product is implicated in disease. An aberrant fusion junction due to rearrangement or deletion is another embodiment of a target site. mRNA transcripts produced via the process of splicing of two (or more) mRNAs from different gene sources are known as "fusion transcripts". Introns can be effectively targeted using antisense compounds targeted to, for example, DNA or pre-mRNA In some embodiments, the antisense oligonucleotides bind to coding and/or non-coding regions of a target polynucleotide and modulate the expression and/or function of the target molecule.

In some embodiments, the antisense oligonucleotides bind to sense polynucleotides and modulate the expression and/or function of the target molecule.

Alternative RNA transcripts can be produced from the same genomic region of DNA. These alternative transcripts are generally known as "variants". More specifically, "pre-mRNA variants" are transcripts produced from the same genomic DNA that differ from other transcripts produced from the same genomic DNA in either their start or stop position and contain both intronic and exonic sequence.

Upon excision of one or more exon or intron regions, or portions thereof during splicing, pre-mRNA variants produce smaller "mRNA variants". Consequently, mRNA variants are processed pre-mRNA variants and each unique pre-mRNA variant must always produce a unique mRNA variant as a result of splicing. These mRNA variants are also known as "alternative splice variants". If no splicing of the pre-mRNA variant occurs then the pre-mRNA variant is identical to the mRNA variant.

Variants can be produced through the use of alternative signals to start or stop transcription. Pre-mRNAs and mRNAs can possess more than one start codon or stop codon. Variants that originate from a pre-mRNA or mRNA that use alternative start codons are known as "alternative start variants" of that pre-mRNA or mRNA. Those transcripts that use an alternative stop codon are known as "alternative stop variants" of that pre-mRNA or mRNA. One specific type of alternative stop variant is the "polyA variant" in which the multiple transcripts produced result from the alternative selection of one of the "polyA stop signals" by the transcription machinery, thereby producing transcripts that terminate at unique polyA sites. In some embodiments, the types of variants described herein are also embodiments of target nucleic acids.

In some embodiments, the locations on the target nucleic acid to which the antisense compounds hybridize are defined as at least a 5-nucleotide long portion of a target region to which an active antisense compound is targeted.

While the specific sequences of certain exemplary target segments are set forth herein, one of skill in the art will recognize that these serve to illustrate and describe particular embodiments. Additional target segments are readily identifiable by one having ordinary skill in the art in view of this disclosure.

Target segments 5-100 nucleotides in length comprising a stretch of at least five (5) consecutive nucleotides selected from within illustrative target segments are considered to be suitable for targeting as well.

In some embodiments, target segments can include DNA or RNA sequences that comprise at least the 5 consecutive nucleotides from the 5'-terminus of one of the target segments (the remaining nucleotides being a consecutive stretch of the same DNA or RNA beginning immediately upstream of the terminus of the target segment and continuing until the DNA or RNA contains about to about 100 nucleotides). In some cases, target segments are represented by DNA or RNA sequences that comprise at least the 5 consecutive nucleotides from the 3'-terminus of one of the target segments (the remaining nucleotides being a consecutive stretch of the same DNA or RNA beginning immediately downstream of the 3'-terminus of the target segment and continuing until the DNA or RNA contains about 5 to about 100 nucleotides).

Once one or more target regions, segments or sites are identified, antisense compounds are chosen which are sufficiently complementary to the target, i.e., hybridize sufficiently well and with sufficient specificity, to give the desired effect.

Antisense compounds include antisense oligonucleotides, ribozymes, external guide sequence (EGS) oligonucleotides, siRNA compounds, single- or double-stranded RNA interference (RNAi) compounds such as siRNA compounds, and other oligomeric compounds which hybridize to at least a portion of the target nucleic acid and modulate its function. As such, they may be DNA, RNA, DNA-like, RNA-like, or mixtures thereof, or may be mimetics of one or more of these. These compounds may be single-stranded, double-stranded, circular or hairpin oligomeric compounds and may contain structural elements such as internal or terminal bulges, mismatches or loops. Antisense compounds are routinely prepared linearly but can be joined or otherwise prepared to be circular and/or branched. Antisense compounds can include constructs such as, for example, two strands hybridized to form a wholly or partially double-stranded compound or a single strand with sufficient self-complementarity to allow for hybridization and formation of a fully or partially double-stranded compound. The two strands can be linked internally leaving free 3' or 5' termini or can be linked to form a continuous hairpin structure or loop. The hairpin structure may contain an overhang on either the 5' or 3' terminus producing an extension of single stranded character. The double stranded compounds optionally can include overhangs on the ends. Further modifications can include conjugate groups attached to one of the termini, selected nucleotide positions, sugar positions or to one of the internucleoside linkages. In some cases, the two strands can be linked via a non-nucleic acid moiety or linker group. When formed from only one strand, dsRNA can take the form of a self-complementary hairpin-type molecule that doubles back on itself to form a duplex. Thus, the dsRNAs can be fully or partially double stranded. Specific modulation of gene expression can be achieved by stable expression of dsRNA hairpins in transgenic cell lines, however, in some embodiments, the gene expression or function is up regulated. When formed from two strands, or a single strand that takes the form of a self-complementary hairpin-type molecule doubled back on itself to form a duplex, the two strands (or duplex-forming regions of a single strand) are complementary RNA strands that base pair in Watson-Crick fashion.

Once introduced to a system, the compounds may elicit the action of one or more enzymes or structural proteins to effect cleavage or other modification of the target nucleic acid or may work via occupancy-based mechanisms. In general, nucleic acids (including oligonucleotides) may be described as "DNA-like" (i.e., generally having one or more 2'-deoxy sugars and, generally, T rather than U bases) or "RNA-like" (i.e., generally having one or more 2'-hydroxyl or 2'-modified sugars and, generally U rather than T bases). Nucleic acid helices can adopt more than one type of structure, most commonly the A- and B-forms. It is believed that, in general, oligonucleotides which have B-form-like structure are "DNA-like" and those which have A-form-like structure are "RNA-like." In some (chimeric) embodiments, an antisense compound may contain both A- and B-form regions.

In some embodiments, the desired oligonucleotides or antisense compounds, comprise at least one of: antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa); small activating RNAs (saRNAs), or combinations thereof.

In some embodiments, the "target segments" identified herein may be employed in a screen for additional compounds that modulate the expression of angiopoietin like 7 (ANGPTL7) polynucleotides. "Modulators" are those compounds that decrease or increase the expression of a nucleic acid molecule encoding ANGPTL7 and which comprise at least a 5-nucleotide portion that is complementary to a target segment. The screening method comprises the steps of contacting a target segment of a nucleic acid molecule encoding sense or natural antisense polynucleotides of ANGPTL7 with one or more candidate modulators, and selecting for one or more candidate modulators which decrease or increase the expression of a nucleic acid molecule encoding ANGPTL7 polynucleotides. Once it is shown that the candidate modulator or modulators are capable of modulating (e.g. either decreasing or increasing) the expression of a nucleic acid molecule encoding ANGPTL7 polynucleotides, the modulator may then be employed in further investigative studies of the function of ANGPTL7 polynucleotides, or for use as a research, diagnostic, or therapeutic agent.

The target segments may be also be combined with their respective complementary antisense compounds to form stabilized double-stranded (duplexed) oligonucleotides.

Such double stranded oligonucleotide moieties modulate target expression and regulate translation as well as RNA processing via an antisense mechanism. Moreover, the double-stranded moieties may be subject to chemical modifications. For example, such double-stranded moieties inhibit the target by the classical hybridization of antisense strand of the duplex to the target, thereby triggering enzymatic degradation of the target.

In some embodiments, an antisense oligonucleotide targets angiopoietin like 7 (ANGPTL7) polynucleotides (e.g. accession number NM 021146), variants, alleles, isoforms, homologs, mutants, derivatives, fragments and complementary sequences thereto. In some cases, the oligonucleotide is an antisense molecule.

In some embodiments, the target nucleic acid molecule is not limited to ANGPTL7 alone but extends to any of the isoforms, receptors, homologs and the like of ANGPTL7 molecules.

In some embodiments, the oligonucleotides are complementary to or bind to nucleic acid sequences of ANGPTL7 transcripts and modulate expression and/or function of ANGPTL7 molecules.

In some embodiments, oligonucleotides comprise sequences of at least 5 consecutive nucleotides of to modulate expression and/or function of ANGPTL7 molecules.

The polynucleotide targets comprise ANGPTL7, including family members thereof, variants of ANGPTL7; mutants of ANGPTL7, including SNPs; noncoding sequences of ANGPTL7; alleles of ANGPTL7; species variants, fragments and the like. In some cases, the oligonucleotide is an antisense molecule.

In some embodiments, the oligonucleotide targeting ANGPTL7 polynucleotides, comprise: antisense RNA, interference RNA (RNAi), short interfering RNA (siRNA); micro interfering RNA (miRNA); a small, temporal RNA (stRNA); or a short, hairpin RNA (shRNA); small RNA-induced gene activation (RNAa); or, small activating RNA (saRNA). In some embodiments, the siRNA comprises one or more sequences selected from SEQ ID NOS: 1-4412. In some embodiments, the siRNA comprises a sequence comprising the reverse complement of a sequence selected from SEQ ID NOS: 1-4412. In some embodiments, the siRNA comprises a sequence having at least about 85%, 90%, or 95% homology to a sequence selected from SEQ ID NOS: 1-4412. In some embodiments, the siRNA comprises a sequence having at least about 85%, 90%, or 95% identity to a sequence selected from SEQ ID NOS: 1-4412.

In some embodiments, targeting of angiopoietin like 7 (ANGPTL7) polynucleotides, e.g. SEQ ID NO: 11085, modulate the expression or function of this target. In some embodiments, expression or function is down-regulated as compared to a control.

In some embodiments, targeting of angiopoietin like 7 (ANGPTL7) polynucleotides, e.g. SEQ ID NO 11086, modulate the expression or function of this target. In some embodiments, expression or function is down-regulated as compared to a control.

In some embodiments, provided are antisense compounds. These oligonucleotides can comprise one or more modified nucleotides, shorter or longer fragments, modified bonds and the like. In some embodiments, antisense compounds comprise sequences set forth as SEQ ID NOS: 4413-11084. In some cases, the antisense compound comprises a sequence at least about 80%, 85%, 90%, 95%, or 100% identical to SEQ ID NO: 11087.

In some embodiments, an antisense compound comprises one or more LNA nucleotides.

In some embodiments, an antisense compound comprises one or more UNA nucleotides.

In some embodiments, an antisense compound comprises one or more GNA nucleotides.

The antisense compounds can comprise an antisense portion from about 5 to about 80 nucleotides (i.e. from about 5 to about 80 linked nucleosides) in length. This refers to the length of the antisense strand or portion of the antisense compound. In other words, a single-stranded antisense compound may comprise from 5 to about 80 nucleotides, and a double-stranded antisense compound (such as a dsRNA, for example) may comprise a sense and an antisense strand or portion of 5 to about 80 nucleotides in length. One of ordinary skill in the art will appreciate that this comprehends antisense portions of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 nucleotides in length, or any range there within.

In some embodiments, the antisense compounds have antisense portions of 10 to 50 nucleotides in length. One having ordinary skill in the art will appreciate that this embodies oligonucleotides having antisense portions of about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range there within. In some embodiments, the oligonucleotides are 15 nucleotides in length.

In some embodiments, the antisense or oligonucleotide compounds have antisense portions of about 12 or 13 to 30 nucleotides in length. One having ordinary skill in the art will appreciate that this embodies antisense compounds having antisense portions of about 12, 13, 14, 15, 16, 17, 18, 19, 20, 21, 22, 23, 24, 25, 26, 27, 28, 29 or 30 nucleotides in length, or any range there within.

In some embodiments, the oligomeric compounds also include variants in which a different base is present at one or more of the nucleotide positions in the compound. For example, if the first nucleotide is an adenosine, variants may be produced which contain thymidine, guanosine or cytidine at this position. This may be done at any of the positions of the antisense or dsRNA compounds. These compounds are then tested using the methods described herein to determine their ability to inhibit expression of a target nucleic acid.

In some embodiments, homology, sequence identity or complementarity, between the antisense compound and target is from about 40% to about 60%. In some embodiments, homology, sequence identity or complementarity, is from about 60% to about 70%. In some embodiments, homology, sequence identity or complementarity, is from about 70% to about 80%. In some embodiments, homology, sequence identity or complementarity, is from about 80% to about 90%. In some embodiments, homology, sequence identity or complementarity, is about 90%, about 92%, about 94%, about 95%, about 96%, about 97%, about 98%, about 99% or about 100%.

In some embodiments, the antisense oligonucleotides, such as for example, nucleic acid molecules set forth in SEQ ID NOS: 4413-11084 comprise one or more substitutions or modifications. In some embodiments, the nucleotides are substituted with locked nucleic acids (LNA). In some cases, the antisense compound comprises a sequence at least about 80%, 85%, 90%, 95%, or 100% identical to SEQ ID NO: 11087.

In some embodiments, the oligonucleotides target one or more regions of the nucleic acid molecules sense and/or antisense of coding and/or non-coding sequences associated with ANGPTL7 and the sequences set forth as SEQ ID NO: 11085.

In some embodiments, oligonucleotides disclosed herein are chimeric oligonucleotides. "Chimeric oligonucleotides" or "chimeras," are oligonucleotides which contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of antisense modulation of gene expression. Consequently, comparable results can often be obtained with shorter oligonucleotides when chimeric oligonucleotides are used, compared to phosphorothioate deoxyoligonucleotides hybridizing to the same target region. Cleavage of the RNA target can be routinely detected by gel electrophoresis and, if necessary, associated nucleic acid hybridization techniques known in the art. In some embodiments, a chimeric oligonucleotide comprises at least one region modified to increase target binding affinity, and, usually, a region that acts as a substrate for RNAse H. Affinity of an oligonucleotide for its target (in this case, a nucleic acid encoding ras) is routinely determined by measuring the Tm of an oligonucleotide target pair, which is the temperature at which the oligonucleotide and target dissociate; dissociation is detected spectrophotometrically. The higher the Tm, the greater is the affinity of the oligonucleotide for the target.

Chimeric antisense compounds may be formed as composite structures of two or more oligonucleotides, modified oligonucleotides, oligonucleosides and/or oligonucleotides mimetics as described above. Such compounds may also be referred to as hybrids or gapmers.

In some embodiments, the composition comprises an oligonucleotide that inhibits the expression of ANGPTL7, wherein the oligonucleotide comprises an antisense oligonucleotide (AS O). In some embodiments, the ASO is 12-30 nucleosides in length. In some embodiments, the ASO is 14-30 nucleosides in length. In some embodiments, the ASO is at least about 10, 11, 12, 13, 14, 15, 15, 17, 18, 19, 20, 21, 22, 23, 24, 25, 26, 27, 28, 29, or 30 nucleosides in length, or a range defined by any of the two aforementioned numbers. In some embodiments, the ASO is 15-25 nucleosides in length. In some embodiments, the ASO is 20 nucleosides in length.

In some embodiments, the composition comprises an oligonucleotide that inhibits the expression of ANGPTL7, wherein the oligonucleotide comprises an antisense oligonucleotide (ASO) about 12-30 nucleosides in length and comprising a nucleoside sequence comprising about 12-30 contiguous nucleosides of a full-length human ANGPTL7 mRNA sequence such as SEQ ID NO: 11085; wherein (i) the oligonucleotide comprises a modification comprising a modified nucleoside and/or a modified internucleoside linkage, and/or (ii) the composition comprises a pharmaceutically acceptable carrier.

In some embodiments, the composition comprises an oligonucleotide that inhibits the expression of ANGPTL7, wherein the oligonucleotide comprises an ASO about 12-30 nucleosides in length and comprising a nucleoside sequence comprising about 12-30 contiguous nucleosides of a full-length human ANGPTL7 mRNA sequence such as SEQ ID NO: 11086; wherein (i) the oligonucleotide comprises a modification comprising a modified nucleoside and/or a modified internucleoside linkage, and/or (ii) the composition comprises a pharmaceutically acceptable carrier.

In some embodiments, the composition comprises an oligonucleotide that inhibits the expression of ANGPTL7, wherein the oligonucleotide comprises an ASO. In some embodiments, the ASO comprises an ASO sequence. In some embodiments, the ASO sequence comprises or consists of the sequence of any one of SEQ ID NOs: 4413-11084, or a nucleic acid sequence thereof having 1, 2, 3, or 4 nucleoside substitutions, additions, or deletions. In some embodiments, the ASO sequence comprises or consists of the sequence of any one of SEQ ID NOs: 4413-11084, or a nucleic acid sequence thereof having 1 or 2 nucleoside substitutions, additions, or deletions. In some embodiments, the ASO sequence comprises or consists of the sequence of any one of SEQ ID NOs: 4413-11084. In some embodiments, the ASO sequence comprises or consists of the sequence of SEQ ID NO: 11087, or a nucleic acid sequence thereof having 1 or 2 nucleoside substitutions, additions, or deletions. In some embodiments, the ASO sequence comprises or consists of the sequence of SEQ ID NO: 11087. In some embodiments, the ASO comprises on or more modifications or modification patterns described herein.

Antisense Compound Modifications

In some embodiments, one or more nucleotides in an antisense compound are modified. The modifications described herein in reference to antisense compounds may be applicable to dsRNA agents or siRNAs.

In some embodiments, the region of the oligonucleotide which is modified comprises at least one nucleotide modified at the 2' position of the sugar, e.g., a 2'-Oalkyl, 2,-0-alkyl-0-alkyl or 2'-fluoro-modified nucleotide. In some embodiments, RNA modifications include 2'-fluoro, 2'-amino and 2' O-methyl modifications on the ribose of pyrimidines, abasic residues or an inverted base at the 3' end of the RNA. Such oligonucleotides may have a higher Tm (i.e., higher target binding affinity) than 2'-deoxyoligonucleotides against a given target. The effect of such increased affinity is to greatly enhance RNAi oligonucleotide inhibition of gene expression. RNAse H is a cellular endonuclease that cleaves the RNA strand of RNA:DNA duplexes; activation of this enzyme therefore results in cleavage of the RNA target, and thus can greatly enhance the efficiency of RNAi inhibition. Cleavage of the RNA target can be routinely demonstrated by gel electrophoresis. In some embodiments, the chimeric oligonucleotide is also modified to enhance nuclease resistance. Cells contain a variety of exo- and endo-nucleases which can degrade nucleic acids. A number of nucleotide and nucleoside modifications make the oligonucleotide into which they are incorporated more resistant to nuclease digestion than the native oligodeoxynucleotide. Nuclease resistance is routinely measured by incubating oligonucleotides with cellular extracts or isolated nuclease solutions and measuring the extent of intact oligonucleotide remaining over time, usually by gel electrophoresis. Oligonucleotides modified to enhance their nuclease resistance survive intact for a longer time than unmodified oligonucleotides. A variety of oligonucleotide modifications have been demonstrated to enhance or confer nuclease resistance. In some cases, oligonucleotides contain at least one phosphorothioate modification. In some cases, oligonucleotide modifications which enhance target binding affinity are also, independently, able to enhance nuclease resistance.

Specific examples of some oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. In some cases, an oligonucleotide comprises a phosphorothioate backbone. In some cases, an oligonucleotide comprises heteroatom backbones, particularly CH2-NH-0-CH2, CH,~N(CH3)-0~CH2 [known as a methylene(methylimino) or MM backbone], CH2-0~N (CH3)~CH2, CH2-N (CH3)-N(CH3)-CH2 and 0~N (CH3)~CH2-CH2 backbones, wherein the native phosphodiester backbone is represented as O—P—O—CH,). In some cases, an oligonucleotide comprises a morpholino backbone structures. In some embodiments, such as the peptide nucleic acid (PNA) backbone, the phosphodiester backbone of the oligonucleotide is replaced with a polyamide backbone, the nucleotides being bound directly or indirectly to the aza nitrogen atoms of the polyamide backbone. Oligonucleotides may also comprise one or more substituted sugar moieties. In some cases, oligonucleotides comprise one of the following at the 2' position: OH, SH, SCH3, F, OCN, OCH3, OCH3 O(CH2)n CH3, O(CH2)n NH2 or O(CH2)n CH3 where n is from 1 to about 10; CI to CIO lower alkyl, alkoxyalkoxy, substituted lower alkyl, alkaryl or aralkyl; CI; Br; CN; CF3; OCF3; 0~, S—, or N-alkyl; 0-, S—, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. Anon-limiting exemplary modification includes 2'-methoxyethoxy [2-0-CH2 CH2 OCH3, also known as 2'-0-(2-methoxyethyl)]. Other exemplary modifications include 2'-methoxy (2'-0~CH3), 2'-propoxy (2'-OCH2 CH2CH3) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Oligonucleotides may also include nucleobase (often referred to as "base") modifications or substitutions. As used herein, "unmodified" or "natural" nucleotides include adenine (A), guanine (G), mymine (T), cytosine (C) and uracil (U). Modified nucleotides include nucleotides found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to as 5-Me-C), 5-hydroxymethylcytosine (HMC), glycosyl HMC and gentobiosyl HMC, as well as synthetic nucleotides, e.g., 2-aminoadenine, 2-(methylamino)adenine, 2-(imidazolylalkyl) adenine, 2-(aminoalklyamino)adenine or other heterosubstituted alkyladenines, 2-thiouracil, 2-tmothvmine, 5-bromouracil, 5-hydroxymethyluracil, 8-azaguanine, 7-deazaguanine, N6 (6-aminohexyl)adenine and 2,6-diaminopurine. A "universal" base, e.g., inosine, may be included. 5-Me-C substitutions increase nucleic acid duplex stability by 0.6-1.2° C. and are suitable base substitutions.

Another modification of the oligonucleotides involves chemically linking to the oligonucleotide one or more moieties or conjugates which enhance the activity or cellular uptake of the oligonucleotide. Such moieties include but are not limited to lipid moieties such as a cholesterol moiety, a cholesteryl moiety, an aliphatic chain, e.g., dodecandiol or undecyl residues, a poly amine or a polyethylene glycol chain, or Adamantane acetic acid. Oligonucleotides comprising lipophilic moieties, and methods for preparing such oligonucleotides are known in the art, for example, U.S. Pat. Nos. 5,138,045, 5,218,105 and 5,459,255.

It is not necessary for all positions in a given oligonucleotide to be uniformly modified, and in fact more than one of the aforementioned modifications may be incorporated in a single oligonucleotide or even at within a single nucleoside within an oligonucleotide. Oligonucleotides may be chimeric oligonucleotides, e.g., as hereinbefore defined.

In some embodiments, the nucleic acid molecule is conjugated with a moiety including but not limited to abasic nucleotides, polyether, polyamine, polyamides, peptides, carbohydrates, lipid, or polyhydrocarbon compounds. Those skilled in the art will recognize that these molecules can be linked to one or more of any nucleotides comprising the nucleic acid molecule at several positions on the sugar, base or phosphate group.

The oligonucleotides may be conveniently and routinely made through the well-known technique of solid phase synthesis. Equipment for such synthesis is sold by several vendors including Applied Biosystems. Any other means for such synthesis may also be employed; the actual synthesis of the oligonucleotides is well within the talents of one of ordinary skill in the art. It is also well known to use similar techniques to prepare other oligonucleotides such as the phosphorothioates and alkylated derivatives. It is also well known to use similar techniques and commercially available modified amiditcs and controlled-pore glass (CPG) products such as biotin, fluorescein, acridine or psoralen-modified amidites and/or CPG (available from Glen Research, Sterling Va.) to synthesize fluorescently labeled, biotinylated or other modified oligonucleotides such as cholesterol-modified oligonucleotides.

In some embodiments, use of modifications such as the use of LNA monomers to enhance the potency, specificity and duration of action and broaden the routes of administration of oligonucleotides comprised of current chemistries such as MOE, ANA, FAN A, PS etc. This can be achieved by substituting some of the monomers in the current oligonucleotides by LNA monomers. The LNA modified oligonucleotide may have a size similar to the parent compound or may be larger or smaller. In some cases, such LNA-modified oligonucleotides contain less than about 70%, less than about 60%, or less than about 50% LNA monomers, and that their sizes are between about 5 and 25 nucleotides, or between about 12 and 20 nucleotides.

In some embodiments, modified oligonucleotide backbones comprise, but are not limited to, phosphorothioates, chiral phosphorothioates, phosphorodithioates, phosphotriesters, aniinoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3-5' linkages, 2-5' linked analogs of these, and those having inverted polarity wherein the adjacent pairs of nucleoside units are linked 3'-5' to 5'-3' or 2'-5' to 5'-2. Various salts, mixed salts and free acid forms are also included.

In some embodiments, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts.

In some embodiments, both the sugar and the internucleoside linkage, i.e., the backbone, of the nucleotide units are replaced with novel groups while the base units are maintained for hybridization with the target nucleic acid. One such oligomeric compound, an oligonucleotide mimetic with excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone.

In some embodiments, the oligonucleotides comprise a heteroatom backbone, e.g., —CH2-NH-0-CH2-, —CH2-N(CH3)-0-CH2- known as a methylene (memylimino) or MMI backbone, —CH2-0-N(CH3)-CH2-, —CH2N(CH3)-N(CH3) CH2-, and -0-N(CH3)-CH2-CH2-, wherein the native phosphodiester backbone is represented as -0-P-0-CH2-0. In some embodiments, oligonucleotides comprise morpholino backbone structures.

Modified oligonucleotides may also contain one or more substituted sugar moieties. In some embodiments, oligonucleotides comprise one of the following at the 2' position: OH; F; 0-, S—, or N-alkyl; 0-, S—, or N-alkenyl; 0-, S- or N-alkynyl; or O alkyl-O-alkyl, wherein the alkyl, alkenyl and alkynyl may be substituted or unsubstituted C to CO alkyl or C2 to CO alkenyl and alkynyl. Non-limiting examples are O (CH2)n OmCH3, O(CH2)n,OCH3, O(CH2)nNH2, O(CH2)nCH3, O(CH2)n0NH2, and O(CH2n0N(CH2)nCH3)2 where n and m can be from 1 to about 10. In some embodiments, oligonucleotides comprise one of the following at the 2' position: C to CO, (lower alkyl, substituted lower alkyl, alkaryl, aralkyl, O-alkaryl or O-aralkyl, SIB SCH3, OCN, CI, Br, CN, CF3, 0CF3, SOCH3, S02CH3, ONO2, NO2, N3, NH2, heterocycloalkyl, heterocycloalkaryl, ammoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. An exemplary modification comprises 2'-methoxy ethoxy (2'-0-CH2CH2OCH3, also known as 2'-0-(2-methoxyethyl) or 2'-MOE) i.e., an alkoxyalkoxy group. Another exemplary modification comprises 2'-dimethylaminooxyethoxy, i.e., a O(CH2)20N(CH3)2 group, also known as 2-DMAOE, as described in examples herein below, and 2'-dimemylaminoethoxyethoxy (also known as 2'-0-dimethylaminoethoxyethyl or 2'-DMAEOE), i.e., 2'-0-CH2-0-CH2-N(CH2)2.

Another exemplary modification comprises 2-methoxy (2-0 CH3), 2'-aminopropoxy (2'-0 CH2CH2CH2NH2) and 2-fluoro (2'-F). Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides may also have sugar mimetic s such as cyclobut 1 moieties in place of the pentofuranosyl sugar.

Oligonucleotides may also comprise nucleobase (often referred to simply as "base") modifications or substitutions. In some embodiments, as used herein, "unmodified" or "natural" nucleotides comprise the purine bases adenine (A) and guanine (G), and the pyrimidine bases mymine (T), cytosine (C) and uracil (U). Modified nucleotides comprise other synthetic and natural nucleotides such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazagnanine and 7-deazaadenine and 3-deazaguanine and 3-deazaadenine.

Certain nucleotides may be particularly useful for increasing the binding affinity of the oligomeric compounds. In some cases, these comprise 5-substituted pyrimidines, 6-azapyrirnidines and N-2, N-6 and 0-6 substituted purines, comprising 2-aminopropyladenine, 5-propynyluracil and/or 5-propynylcytosine. 5-methylcytosine substitutions increase nucleic acid duplex stability by 0.6-1.2° C., even more particularly when combined with 2'-Omethoxy ethyl sugar modifications.

Another modification of the oligonucleotides involves chemically linking to the oligonucleotide one or more moieties or conjugates, which may enhance the activity, cellular distribution, or cellular uptake of the oligonucleotide. Such moieties comprise but are not limited to, lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-0-hexadecyl-rac-glycero-3-H-phosphonate, a polyamine or a polyethylene glycol chain, or Adamantane acetic acid, a palmityl moiety, or an octadecylamine or hexylamino-carbonyl-t oxycholesterol moiety.

In some embodiments, the composition comprises an oligonucleotide that inhibits the expression of ANGPTL7, wherein the oligonucleotide comprises an antisense oligonucleotide (ASO). In some embodiments, the ASO comprises modification pattern ASO1: 5'-nsnsnsnsnsndNsdNsdNsdNsdNsdNsdNsdNsdNsnsnsnsnsn-3' (SEQ ID NO: 11380), wherein "dN" is any deoxynucleotide, "n" is a 2'O-methyl or 2'O-methoxyethyl-modified nucleoside, and "s" is a phosphorothioate linkage. In some embodiments, the ASO comprises modification pattern 1S, 2 S, 3S, 4S, 5S, 1AS, 2AS, 3AS, or 4AS.

Ligands

A wide variety of entities can be coupled to the oligonucleotides described herein. In some embodiments, the entities are ligands, which are coupled, e.g., covalently, either directly or indirectly via an intervening tether. In some embodiments, a ligand is coupled to a dsRNA agent. In some embodiments, a ligand is coupled to an antisense compound.

In some embodiments, a ligand alters the distribution, targeting or lifetime of the molecule into which it is incorporated. In some embodiments a ligand provides an enhanced affinity for a selected target, e.g., molecule, cell or cell type, compartment, receptor e.g., a cellular or organ compartment, tissue, organ or region of the body, as, e.g., compared to a species absent such a ligand. Ligands providing enhanced affinity for a selected target are also termed targeting ligands. These moieties or conjugates can include conjugate groups covalently bound to functional groups such as primary or secondary hydroxyl groups. Conjugate groups include intercalators, reporter molecules, polyamines, poly amides, polyethylene glycols, poly ethers, groups that enhance the pharmacodynamic properties of oligomers, and groups that enhance the pharmacokinetic properties of oligomers. Typicalconjugate groups include cholesterols, lipids, phospholipids, biotin, phenazine, folate, phenanthridine, anthraquinone, acridine, fluoresceins, rhc-«Jamines, coumarins, and dyes. Groups that enhance the pharmacodynamic properties include groups that improve uptake, enhance resistance to degradation, and or strengthen sequence-specific hybridization with the target nucleic acid. Groups that enhance the pharmacokinetic properties include groups that improve uptake, distribution, metabolism or excretion of the compounds herein. Conjugate moieties include, but are not limited to, lipid moieties such as a cholesterol moiety, cholic acid, a thioether, e.g., hexyl-5-tritylthiol, a thiocholesterol, analiphatic chain, e.g., dodecandiol or undecyl residues, a phospholipid, e.g., di-hexadecyl-rac-glycerol or triethylammonium 1,2-di-0-hexadecyl-rac-glycero-3-Hphosphonate, a polyamine or a polyethylene glycol chain, or Adamantane acetic acid, a palmityl moiety, or an octadecylamine or hexylamino-carbonyl-oxycholesterol moiety. Oligonucleotides may also be conjugated to active drug substances, for example, aspirin, warfarin, phenylbutazone, ibuprofen, suprofen, fenbufen, ketoprofen, (S)-(+)-pranoprofen, carprofen, dansylsarcosine, 2,3,5-triiodobenzoic acid, flufenamic acid, folinic acid, a benzolhiadiazide, chlorothiazide, a diazepine, indomethicin, a barbiturate, a cephalosporin, a sulfa drug, an antidiabetic, an antibacterial or an antibiotic.

Some ligands can have endosomolytic properties. The endosomolytic ligands promote the lysis of the endosome and/or transport of the composition, or its components, from the endosome to the cytoplasm of the cell. The endosomolytic ligand may be a polyanionic peptide or peptidomimetic which shows pH-dependent membrane activity and fusogenicity. In some embodiments, the endosomolytic ligand assumes its active conformation at endosomal pH. The "active" conformation is that conformation in which the endosomolytic ligand promotes lysis of the endosome and/or transport of the composition, or its components, from the endosome to the cytoplasm of the cell. Exemplary endosomolytic ligands include the GALA peptide, the EALA peptide, and their derivatives. In some embodiments, the endosomolytic component may contain a chemical group (e.g., an amino acid) which will undergo a change in charge or protonation in response to a change in pH. The endosomolytic component may be linear or branched. Ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; and nuclease-resistance conferring moieties. General examples include lipids, steroids, vitamins, sugars, proteins, peptides, polyamines, and peptide mimics.

Ligands can include a naturally occurring substance, such as a protein (e.g., human serum albumin (HSA), low-density lipoprotein (LDL), high-density lipoprotein (HDL), or globulin); a carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an arginine-glycine-aspartic acid (RGD) peptide, an RGD peptide mimetic or an aptamer.

Additional examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases or a chelator (e.g. EDTA), lipophilic molecules, e.g, cholesterol, cholic acid, adamantane acetic acid, 1-pyrene butyric acid, dihydrotestosterone, 1,3-Bis-0(hexadecyl)glycerol, geranyloxyhexyl group, hexadecylglycerol, borneol, menthol, 1,3-propanediol, heptadecyl group, palmitic acid, myristic acid,03-(oleoyl)lithocholic acid, 03-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors.

They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, an activator of p38 MAP kinase, or an activator of NF-KB.

The ligand can be a substance, e.g., a drug, which can increase the uptake of the siRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

The ligand can increase the uptake of the oligonucleotide into the cell by activating an inflammatory response, for example. Exemplary ligands that would have such an effect include tumor necrosis factor alpha (TNF alpha), interleukin-1 beta, or gamma interferon.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include B vitamins, e.g., folic acid, B12, riboflavin, biotin, pyridoxal or other vitamins or nutrients taken up by cancer cells. Also included are HAS, low density lipoprotein (LDL) and high-density lipoprotein (HDL). In another aspect, the ligand is a cell-permeation agent, e.g., a helical cell-permeation agent. In some cases, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is may be an alpha-helical agent, which may have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The peptide or peptidomimetic moiety can be about 3-50 amino acids long, e.g., about 3, 5, 10, 15, 20, 25, 30, 35, 40, 45, or 50 amino acids long. A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In some cases, the peptide moiety can include a hydrophobic membrane translocation sequence (MTS). An exemplary hydrophobic MTS-containing peptide is RFGF derived from human fibroblast growth factor 4 and having the amino acid sequence AAVALLPAVLLALLAP (SEQ ID NO: 11390), an RFGF analogue (e.g., amino acid sequence AALLPVLLAAP (SEQ ID NO: 11391) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ, SEQ ID NO: 11392) and the *Drosophila* Antennapedia protein (RQIKIWFQNRRMKWK, SEQ ID NO: 11393) are capable of functioning as delivery peptides. A peptide or peptidomimetic can be encoded by a random sequence of DNA, such as a peptide identified from a phage-display library, or one-bead-one-compound (OBOC) combinatorial library. In some cases, the peptide or peptidomimetic tethered to an antisense oligonucleotide or siRNA agent via an incorporated monomer unit is a cell targeting peptide such as an arginine-glycine-aspartic acid (RGD)-peptide, or RGD mimic. A peptide moiety can range in length from about 3 amino acids to about 40 amino acids. The peptide moieties can have a structural modification, such as to increase stability or direct conformational properties. Any of the structural modifications described below can be utilized. An RGD peptide moiety can be used to target a tumor cell, such as an endothelial tumor cell or a breast cancer tumor cell. An RGD peptide can facilitate targeting of an siRNA agent to tumors of a variety of other tissues, including the lung, kidney, spleen, or liver. In some cases, the RGD peptide will facilitate targeting of an siRNA agent to the kidney. The RGD peptide may also be used to facilitate targeting of an siRNA agent to different cell types in the eye. RGD-binding integrins, such as the avb3 integrin pair, are expressed in trabecular meshwork, sclera, and ciliary body of the mouse anterior segment. The RGD peptide can be linear or cyclic, and can be modified, e.g., glycosylated or methylated to facilitate targeting to specific tissues. For example, a glycosylated RGD peptide can deliver an siRNA agent to a tumor cell expressing yB3. Peptides that target markers enriched in proliferating cells can be used. E.g., RGD containing peptides and peptidomimetics can target cancer cells, in particular cells that exhibit an integrin. Thus, one could use RGD peptides, cyclic peptides containing RGD, RGD peptides that include D-amino acids, as well as synthetic RGD mimics. In addition to RGD, one can use other moieties that target the integrin ligand. Generally, such ligands can be used to control proliferating cells and angiogenesis. Exemplary conjugates of this type ligands that targets PECAM-1, VEGF, or other cancer gene, e.g., a cancer gene described herein. Cell binding ligands may be composed of multiple ligands (multivalency) to increase binding affinity. For example, more than one integrin-binding ligand may be combined. Without limiting the structures that bind to integrins, an example of a cyclic peptide RGD ligand is Cyclo(-Arg-Gly-Asp-D-Phe-Xaa) where Xaa is an amino acid with a sidechain that is amenable to conjugation. Naturally occurring examples of X include cysteine where a thiol is used for conjugation, lysine where an amine is used for conjugation. In addition, non-natural amino acids may have other functional groups such as alkynes, azides, maleimides for conjugation.

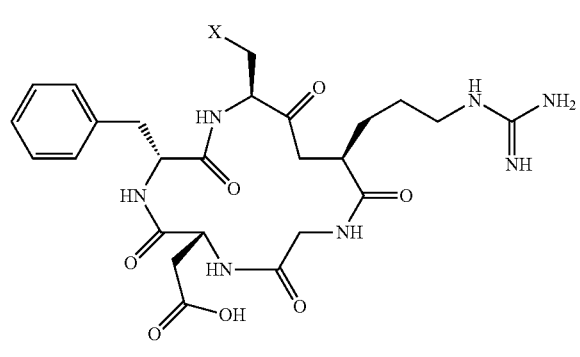

Cyclo(-Arg-Gly-Asp-D-Phe-X)

An example of a noncyclic, peptidomimetic is an amino benzoic acid derivative where in X is a site of conjugation.

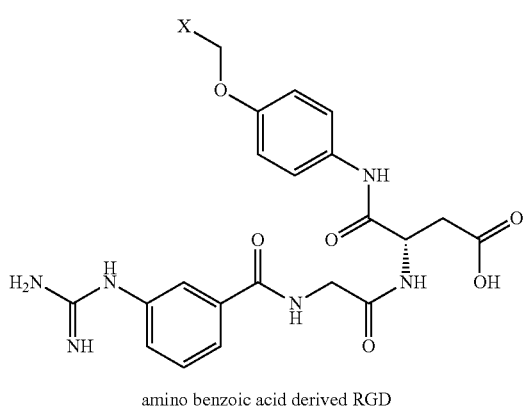

amino benzoic acid derived RGD

Some embodiments include an RGD ligand attached at either a 3' terminus or a 5' terminus. Some embodiments include an RGD ligand attached at a 3' terminus and a 5' terminus. In some embodiments, the RGD ligand comprises Cyclo(-Arg-Gly-Asp-D-Phe-Cys), Cyclo(-Arg-Gly-Asp-D-Phe-Lys), Cyclo(-Arg-Gly-Asp-D-Phe-azido), Cyclo(-Arg-Gly-Asp-D-Phe-alkynyl), amino benzoic acid-based RGD, or a combination thereof. In some embodiments, the RGD ligand is composed of 2, 3 or 4 RGD ligands. In some embodiments, the RGD is positioned on the sense strand. In some embodiments, the RGD is positioned at the 5' end of the sense strand. In some embodiments, the RGD is positioned at the 3' end of the sense strand. In some embodiments, the RGD is positioned on the antisense strand. In some embodiments, the RGD ligand is positioned at the 5' end of the antisense strand. In some embodiments, the RGD ligand is positioned at the 3' end of the antisense strand.

In some embodiments, a "cell permeation peptide" is capable of permeating a cell, e.g., a microbial cell, such as a bacterial or fungal cell, or a mammalian cell, such as a human cell. A microbial cell-permeating peptide can be, for example, an a-helical linear peptide (e.g., LL-37 or Ceropin PI), a disulfide bond-containing peptide (e.g., a-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen.

In some embodiments, a targeting peptide can be an amphipathic a-helical peptide. Exemplary amphipathic α-helical peptides include, but are not limited to, cecropins, lycotoxins, paradaxins, buforin, CPF, bombinin-like peptide (BLP), cathelicidins, ceratotoxins, S. clava peptides, hagfish intestinal antimicrobial peptides (HFIAPs), magainines, brevinins-2, dermaseptins, melittins, pleurocidin, H2A peptides, Xenopus peptides, esculentinis-1, and caerins. A number of factors may be considered to maintain the integrity of helix stability. For example, a maximum number of helix stabilization residues will be utilized (e.g., leu, ala, or lys), and a minimum number helix destabilization residues will be utilized (e.g., proline, or cyclic monomeric units. The capping residue will be considered (for example Gly is an exemplary N-capping residue and/or C-terminal amidation can be used to provide an extra H-bond to stabilize the helix. Formation of salt bridges between residues with opposite charges, separated by i±3, or i±4 positions can provide stability. For example, cationic residues such as lysine, arginine, homo-arginine, ornithine or histidine can form salt bridges with the anionic residues glutamate or aspartate.

Peptide and peptidomimetic ligands include those having naturally occurring or modified peptides, e.g., D or L peptides; α, β, or γ peptides; N-methyl peptides; azapeptides; peptides having one or more amide, i.e., peptide, linkages replaced with one or more urea, thiourea, carbamate, or sulfonyl urea linkages; or cyclic peptides.

The targeting ligand can be any ligand that is capable of targeting a specific receptor. Examples are: folate, GalNAc, galactose, mannose, mannose-6P, clusters of sugars such as GalNAc cluster, mannose cluster, galactose cluster, or an aptamer. A cluster is a combination of two or more sugar units. The targeting ligands also include integrin receptor ligands, Chemokine receptor ligands, transferrin, biotin, serotonin receptor ligands, PSMA, endothelin, GCPII, somatostatin, LDL and HDL ligands. The ligands can also be based on nucleic acid, e.g., an aptamer. The aptamer can be unmodified or have any combination of modifications disclosed herein.

Endosomal release agents include imidazoles, poly or oligoimidazoles, PEIs, peptides, fusogenic peptides, polycarboxylates, polycations, masked oligo or poly cations or anions, acetals, polyacetals, ketals/polyketyals, orthoesters, polymers with masked or unmasked cationic or anionic charges, dendrimers with masked or unmasked cationic or anionic charges.

PK modulator stands for pharmacokinetic modulator. PK modulator include lipophiles, bile acids, steroids, phospholipid analogues, peptides, protein binding agents, PEG, vitamins etc. Exemplary PK modulator include, but are not limited to, cholesterol, fatty acids, cholic acid, lithocholic acid, dialkylglycerides, diacylglyceride, phospholipids, sphingo lipids, naproxen, ibuprofen, vitamin E, biotin etc. Oligonucleotides that comprise a number of phosphorothioate linkages are also known to bind to serum protein, thus short oligonucleotides, e.g. oligonucleotides of about 5 bases, 10 bases, 15 bases or 20 bases, comprising multiple of phosphorothioate linkages in the backbone are also amenable as ligands (e.g. as PK modulating ligands).

In addition, aptamers that bind serum components (e.g. serum proteins) are also amenable as PK modulating ligands.

When two or more ligands are present, the ligands can all have same properties, all have different properties or some ligands have the same properties while others have different properties. For example, a ligand can have targeting properties, have endosomolytic activity or have PK modulating properties. In some embodiments, all the ligands have different properties.

Ligands can be coupled to the oligonucleotides at various places, for example, 3'-end, 5'-end, and/or at an internal position. In some embodiments, the ligand is attached to the oligonucleotides via an intervening tether, e.g. a carrier described herein. The ligand or tethered ligand may be present on a monomer when said monomer is incorporated into the growing strand. In some embodiments, the ligand may be incorporated via coupling to a "precursor" monomer after said "precursor" monomer is incorporated into the growing strand. For example, a monomer having, e.g., an amino-terminated tether (i.e., having no associated ligand), e.g., TAP-(CH2)nNH2 may be incorporated into a growing oligonucleotide strand. In a subsequent operation, i.e., after incorporation of the precursor monomer into the strand, a ligand having an electrophilic group, e.g., a pentafluorophenyl ester or aldehyde group, can subsequently be attached to the precursor monomer by coupling the electrophilic group of the ligand with the terminal nucleophilic group of the precursor monomer's tether. In another example, a monomer having a chemical group suitable for taking part in Click Chemistry reaction may be incorporated e.g., an azide or alkyne terminated tether/linker. In a subsequent operation, i.e., after incorporation of the precursor monomer into the strand, a ligand having complementary chemical group, e.g. an alkyne or azide can be attached to the precursor monomer by coupling the alkyne and the azide together.

For double-stranded oligonucleotides, ligands can be attached to one or both strands. In some embodiments, a double-stranded siRNA agent contains a ligand conjugated to the sense strand. In some embodiments, a double-stranded siRNA agent contains a ligand conjugated to the antisense strand.

In some embodiments, ligand can be conjugated to nucleobases, sugar moieties, or internucleosidic linkages of nucleic acid molecules. Conjugation to purine nucleobases or derivatives thereof can occur at any position including, endocyclic and exocyclic atoms. In some embodiments, the 2-, 6-, 7-, or 8-positions of a purine nucleobase are attached to a conjugate moiety. Conjugation to pyrimidine nucleobases or derivatives thereof can also occur at any position. In some embodiments, the 2-, 5-, and 6-positions of a pyrimidine nucleobase can be substituted with a conjugate moiety. Conjugation to sugar moieties of nucleosides can occur at any carbon atom. Example carbon atoms of a sugar moiety that can be attached to a conjugate moiety include the 2', 3', and 5' carbon atoms. The F position can also be attached to a conjugate moiety, such as in an abasic residue. Internucleosidic linkages can also bear conjugate moieties. For phosphorus-containing linkages (e.g., phosphodiester, phosphorothioate, phosphorodithiotate, phosphoroamidate, and the like), the conjugate moiety can be attached directly to the phosphorus atom or to an O, N, or S atom bound to the phosphorus atom. For amine- or amide-containing internucleosidic linkages (e.g., PNA), the conjugate moiety can be attached to the nitrogen atom of the amine or amide or to an adjacent carbon atom.

Any suitable ligand in the field of RNA interference may be used, although the ligand is typically a carbohydrate e.g. monosaccharide (such as GalNAc), disaccharide, trisaccharide, tetrasaccharide, polysaccharide. Linkers that conjugate the ligand to the nucleic acid include those discussed above. For example, the ligand can be one or more GalNAc (N-acetylglucosamine) derivatives attached through a bivalent or trivalent branched linker.

Cleavable Linking Groups

In some embodiments, an oligonucleotide compound or composition comprising an oligonucleotide compound comprises a cleavable linking group. In some cases a dsRNA agent comprises or is connected to a cleavable linking group. In some cases an antisense compound comprises or is connected to a cleavable linking group.

In some embodiments, a cleavable linking group is one which is sufficiently stable outside the cell, but which upon entry into a target cell is cleaved to release the two parts the linker is holding together. In some embodiments, the cleavable linking group is cleaved at least 10 times or more, or at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH redox potential or the presence of degradative agents. Generally, cleavage agents are more prevalent or found at higher levels or activities inside cells than in serum or blood.

Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH in the range of 5.5-6.0, and lysosomes have an even more acidic pH at around 5.0. Some linkers will have a cleavable linking group that is cleaved at a particular pH thereby releasing the cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, liver targeting ligands can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes. In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It may be useful to make initial evaluations in cell-free or culture conditions and to confirm by further evaluations in whole animals. In some embodiments, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

Redox Cleavable Linking Groups

One class of cleavable linking groups are redox cleavable linking groups that are cleaved upon reduction or oxidation. An example of reductively cleavable linking group is a disulphide linking group (—S—S—). To determine if a candidate cleavable linking group is a suitable "reductively cleavable linking group," or for example is suitable for use with a particular oligonucleotide and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In some embodiments, candidate compounds are cleaved by at most 10% in the blood. In some embodiments, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups

Phosphate-based cleavable linking groups are cleaved by agents that degrade or hydro lyze the phosphate group. An example of an agent that cleaves phosphate groups in cells are enzymes such as phosphatases in cells. Examples of phosphate-based linking groups are -0-P(0)(ORk)-0-, -0-P(S)(ORk)-0-, -0-P(S)(SRk)-0-, —S—P(0)(ORk)-0-, -0-P(0)(ORk)-S—, —S—P(0)(ORk)-S—, -0-P(S)(ORk)-5-, —S—P(S)(ORk)-0-, -0-P(0)(Rk)-0-, -0-P(S)(Rk)-0-, —S—P(0)(Rk)-0-, —S—P(S)(Rk)-0-, —S—P(0)(Rk)-S—, -0-P(S)(Rk)-S—. Some embodiments are -0-P(0)(OH)-0-, -0-P(S)(OH)-0-, -0-P(S)(SH)-0-, —S—P(0)(OH)-0-, -0-P(0)(OH)—S—, —S—P(0)(OH)—S—, -0-P(S)(OH)—S—, —S—P(S)(OH)-0-, -0-P(0)(H)-0-, -0-P(S)(H)-0-, —S—P(0)(H)-0-, —S—P(S)(H)-0-, —S—P(0)(H)—S—, -0-P(S)(H)— S—. An exemplary embodiment is-0-P(0)(OH)-0-. These candidates can be evaluated using methods analogous to those described above.

Acid Cleavable Linking Groups

Acid cleavable linking groups are linking groups that are cleaved under acidic conditions. In some embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN— C(0)0, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Linking Groups

Ester-based cleavable linking groups are cleaved by enzymes such as esterases and amidases in cells. Examples of ester-based cleavable linking groups include but are not limited to esters of alkylene, alkenylene and alkynylene groups. Ester cleavable linking groups have the general formula —C(0)0-, or —OC(O)—. These candidates can be evaluated using methods analogous to those described above.

Peptide-Based Cleaving Groups

Peptide-based cleavable linking groups are cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynylene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(0)NHCHRBC(0)-, where RA and RB are the R groups of the two adjacent amino acids. These candidates can be evaluated using methods analogous to those described above. As used herein, "carbohydrate" refers to a compound which is either a carbohydrate per se made up of one or more monosaccharide units having at least 6 carbon atoms (which may be linear, branched or cyclic) with an oxygen, nitrogen or sulfur atom bonded to each carbon atom; or a compound having as a part thereof a carbohydrate moiety made up of one or more monosaccharide units each having at least six carbon atoms (which may be linear, branched or cyclic), with an oxygen, nitrogen or sulfur atom bonded to each carbon atom. Representative carbohydrates include the sugars (mono-, di-, tri- and oligosaccharides containing from about 4-9 monosaccharide units), and polysaccharides such as starches, glycogen, cellulose and polysaccharide gums. Specific monosaccharides include C5 and above (e.g., C5-C8) sugars; di- and trisaccharides include sugars having two or three monosaccharide units (e.g., C5-C8).

Nucleotide Mimics

In some embodiments, an oligonucleotide disclosed herein is a naked oligonucleotide. Naked oligonucleotides are defined as systems that contain no agents that are associated with the nucleic acid either covalently or non-covalently. The absence of any delivery vehicle may require that the oligonucleotide itself be sufficiently nuclease resistant, sufficiently long circulating and cell targeted. For small, solid-phase synthesized oligonucleotides such as those used in antisense oligonucleotides, RNAi, and innate immune stimulators, the use of nucleotide mimics may provide the required drug-like properties.

In some embodiments, an oligonucleotide of the present disclosure comprises nucleotides that replace phosphodiester group. The substitution of one non-bridging oxygen of a phosphodiester with a sulfur atom creates the phosphorothioate (PS) linkage. APS bond creates anew stereocenter in the nucleotide and when synthesized under standard achiral conditions creates diastereomeric mixtures of Rp and Sp at the phosphorous atom.

There are other functional groups identified as replacements of the phosphodiester group in the oligonucleotide. Like phosphates and phosphorothioates, there are a variety of functional groups that are negatively charged such as phosphorodithioate (PS2) and thio-phosphoramidates. There are number of analogues that are uncharged such as phosphorodiamidate morpholino oligomer (PMO), peptide nucleic acid (PNA), phosphotriesters, and phosphonates. It is postulated that the uncharged analogues are not only nuclease resistant, but may also be more membrane permeable; however, the size and hydrophilicity of uncharged oligonucleotides still preclude their passive diffusion across membranes.

Morpholino oligos (PMOs) use a hydrolytically stable, uncharged phosphordiamidate functional group.

Peptide nucleic acids (PNAs) are—as their name suggests—based upon the amide functional group.

Enemas and intramuscular, intravitreal, intrathecal injections may be used for the administration of a variety of oligonucleotides with and without PS bonds.

In some embodiments, an oligonucleotide of the present disclosure comprises a nucleoside analogue that alters the structure of ribose. There are a variety of nucleotide mimics wherein the ribose or deoxyribose is modified to increase affinity for target and/or increase nuclease resistance. In some cases, there are modifications to all five positions of the ribose ring. In some cases, modifications are made to the 2' position of ribose.

In some embodiments, an oligonucleotide of the present disclosure comprises a modifications at the 1' position. In some cases, the oligonucleotide comprises a cytidine mimic that is designed to have increased affinity for guanosine bases due to hydrogen bonding through an aminoethyl group. In some cases, the oligonucleotide comprises a C-5 propynyl pyrimidines.

In some embodiments, an oligonucleotide of the present disclosure comprises a 2' modifications. Modifications of the hydroxyl group at the 2' position of ribose may be used to mimic the structure of the ribose ring while inhibiting ribonucleases that require the 2' OH group for hydrolysis of RNA. In some cases, the oligonucleotide comprises a 2'-O-Methyl ribonucleic acid that is naturally occurring and may increase binding affinity to RNA itself while being resistant to ribonuclease. In some cases, the oligonucleotide comprises a 2'-O-Methyl group. In some cases, the oligonucleotide comprises a 2'-O-Methoxyethyl(MOE) modification, which may mimic the ribonuclease resistance of O-methyl, attenuate protein-oligonucleotide interactions and have increased affinity for RNA In some embodiments, an oligonucleotide of the present disclosure comprises a 2'-deoxy-2'-fluoro (2'-F) analogue of nucleosides that adopt a C3'-endo conformation characteristic of the sugars in RNA helices.

In some embodiments, an oligonucleotide of the present disclosure comprises a 4'- and 5'-modifications, where alkoxy substituents at the 4' position of 2'deoxyribose mimic the conformation of ribose.

In some embodiments, an oligonucleotide of the present disclosure comprises a bicyclic 2'-4'-modification. There are a variety of ribose derivatives that lock the carbohydrate ring into the 3' endo conformation by the formation of bicyclic structures with a bridge between the 2' oxygen and the 4' position. The original bicyclic structure has a methylene bridging group and are termed locked nucleic acids (LNAs). The bicyclic structure "locks" the ribose into its preferred 3' endo conformation and increases base pairing affinity. Incorporation of LNAs into a DNA duplex can increase melting points up to 8° C. per LNA. Subsequently, a variety of bicyclic nucleotides have been developed such as Bridged Nucleic Acids (BNAs), Ethyl-bridged (ENAs), constrained ethyl (cEt) nucleic acids and tricyclic structures with varying affinity for target sites. LNAs can be incorporated into antagomirs, splice blocking oligonucleotides, either strand of an RNAi duplex; however, like other 3' endo conformers, LNAs are not substrates for RNAse H.

In some embodiments, an oligonucleotide of the present disclosure comprises an acyclic nucleic acid analog. In some cases, the analog comprises an alternative ribose ring structure. These include those in which the bond between 2' and 3' carbons in the ribose is absent, as well as those containing substitution of the ribose ring with a three-carbon backbone. Examples of acyclic nucleic acid analogs include unlocked nucleic acid (UNA) and glycol nucleic acids (GNA). Incorporation of these analogs reduce the melting temperature of the RNAi duplex and can be incorporated into either strand. Incorporation at the 5' end of the sense strand, or passenger strand, inhibits incorporation into this strand into RISC. Incorporation into the seed region of the antisense strand, or guide strand, can reduce off-target activity. Acyclic nucleic acid analogs may also increase resistance of the RNAi duplex to 3'-exonuclease activity.

In some embodiments, an oligonucleotide of the present disclosure comprises a modification patterns. Without being bound by theory, for RNAi duplexes, recognition by RISC requires RNA-like 3'-endo nucleotides and some patterns of RNA analogues. A pattern of alternating 2'-O-methyl groups may provide stability against nucleases, but not all permutations of alternating 2' O-methyl are active RNAi agents. The fact that one may remove all 2'-hydroxy groups with alternating 2'-fluoro and 2'-O-methyl groups to produce duplexes that are resistant to nucleases and active in RNAi may suggest the 2'-hydroxy group is not absolutely required for activity, but that some sites in the RNAi duplex are sensitive to the added steric bulk of the methyl group.

Conjugated Oligonucleotides

Oligonucleotides may have groups conjugated via covalent bonds that prolong circulation, provide targeting to tissues and facilitate intracellular delivery.

In some embodiments, an oligonucleotide of the present disclosure is conjugated to polyethylene glycol (PEG), which may prevent clearance by two mechanisms: the increase in molecular weight above threshold for renal clearance and the prevention of non-specific interactions with extracellular surfaces and serum components. PEG may be incorporated into nucleic acid delivery vehicles by attachment to components that non-covalently associate with the nucleic acids, e.g. PEGylated lipids and polymers. PEG may also be directly conjugated to increase nucleic acid circulation times, decrease nonspecific interactions and alter biodistribution. In some cases, the targeting is passive and the potency of the nucleic may be compromised as PEG MW increases.

Another class of molecules that can be conjugated in order to increases circulation times is the attachment of lipophilic groups such as cholesterol or other lipophilic moiety with >12 carbons which interact with serum components such as albumen and lipoproteins thereby increasing circulation times and passive accumulation in the liver. In some cases, extensive PS modification increases circulation times through associations with serum components, with roughly 10 PS groups required for serum binding.

Formulations, Compositions, and Delivery

In some embodiments, the antisense oligonucleotide or dsRNA is administered in buffer.

In some embodiments, antisense oligonucleotide or dsRNA agent (sometimes referred to as siRNA) compounds described herein can be formulated for administration to a subject. A formulated antisense oligonucleotide or siRNA composition can assume a variety of states. In some examples, the composition is at least partially crystalline, uniformly crystalline, and/or anhydrous (e.g., less than 80, 50, 30, 20, or 10% water). In another example, the antisense oligonucleotide or siRNA is in an aqueous phase, e.g., in a solution that includes water.

The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the antisense oligonucleotide or siRNA composition is formulated in a manner that is compatible with the intended method of administration, as described herein. For example, in particular embodiments the composition is prepared by at least one of the following methods: spray drying, lyophilization, vacuum drying, evaporation, fluid bed drying, or a combination of these techniques; or sonication with a lipid, freeze-drying, condensation and other self-assembly.

An antisense oligonucleotide or siRNA preparation can be formulated in combination with another agent, e.g., another therapeutic agent or an agent that stabilizes an antisense oligonucleotide or siRNA, e.g., a protein that complexes with siRNA to form an iRNP. Still other agents include chelators, e.g., EDTA (e.g., to remove divalent cations such as Mg2+), salts, RNAse inhibitors (e.g., a broad specificity RNAse inhibitor such as RNAsin) and so forth.

In some embodiments, the antisense oligonucleotide or siRNA preparation includes another antisense oligonucleotide or siRNA compound, e.g., a second siRNA that can mediate RNAi with respect to a second gene, or with respect to the same gene. Still other preparation can include at least 3, 5, ten, twenty, fifty, or a hundred or more different antisense oligonucleotide or siRNA species. Such siRNAs can mediate RNAi with respect to a similar number of different genes.

In some embodiments, the antisense oligonucleotide or siRNA preparation includes at least a second therapeutic agent (e.g., an agent other than a RNA or a DNA). For example, an antisense oligonucleotide or siRNA composition for the treatment of a viral disease, e.g., HIV, might include a known antiviral agent (e.g., a protease inhibitor or reverse transcriptase inhibitor). In another example, a siRNA composition for the treatment of a cancer might further comprise a chemotherapeutic agent.

Liposomes

For ease of exposition the formulations, compositions and methods in this section are discussed largely with regard to unmodified antisense oligonucleotide or siRNA compounds. It may be understood, however, that these formulations, compositions and methods can be practiced with other antisense oligonucleotide or siRNA compounds, e.g., modified antisense oligonucleotide or siRNAs. An antisense oligonucleotide or siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) preparation can be formulated for delivery in a membranous molecular assembly, e.g., a liposome or a micelle. In some embodiments, the term "liposome" refers to a vesicle with amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the antisense oligonucleotide or siRNA composition. The lipophilic material isolates the aqueous interior from an aqueous exterior, which typically does not include the antisense oligonucleotide or siRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the antisense oligonucleotide or siRNA are delivered into the cell where the antisense oligonucleotide or siRNA can specifically bind to a target RNA. In some cases the liposomes are also specifically targeted, e.g., to direct the antisense oligonucleotide or siRNA to particular cell types.

A liposome containing an antisense oligonucleotide or siRNA can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The antisense oligonucleotide or siRNA preparation is then added to the micelles that include the lipid component. The cationic groups on the lipid interact with the antisense oligonucleotide or siRNA and condense around the antisense oligonucleotide or siRNA to form a liposome. After condensation, the detergent is removed, e.g., by dialysis, to yield a liposomal preparation of antisense oligonucleotide or siRNA If necessary a carrier compound that assists in condensation can be added during the condensation reaction, e.g., by controlled addition. For example, the carrier compound can be a polymer other than a nucleic acid {e.g., spermine or spermidine). pH can also be adjusted to favor condensation.

Commonly used techniques for preparing lipid aggregates of appropriate size for use as delivery vehicles include sonication and freeze-thaw plus extrusion. Microfluidization can be used when consistently small (50 to 200 nm) and relatively uniform aggregates are desired. These methods are readily adapted to packaging antisense oligonucleotide or siRNA preparations into liposomes.

Liposomes that are pH-sensitive or negatively-charged entrap nucleic acid molecules rather than complex with them. Since both the nucleic acid molecules and the lipid are similarly charged, repulsion rather than complex formation occurs.

Nevertheless, some nucleic acid molecules are entrapped within the aqueous interior of these liposomes. pH-sensitive liposomes may be used to deliver DNA encoding the thymidine kinase gene to cell monolayers in culture where expression of the exogenous gene was detected in the target cells.

One type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

In some embodiments, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver antisense oligonucleotide or siRNAs to macrophages.

Further advantages of liposomes include: liposomes obtained from natural phospholipids are biocompatible and biodegradable; liposomes can incorporate a wide range of water and lipid soluble drugs; liposomes can protect encapsulated antisense oligonucleotide or siRNAs in their internal compartments from metabolism and degradation. Some considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of siRNA A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that conjugate to a variety of moieties including, for example, carboxyspermine which may be conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES").

Another cationic lipid conjugate includes derivatization of the lipid with cholesterol ("DC-Choi") which may be formulated into liposomes in combination with DOPE. Lipopolylysine, made by conjugating polylysine to DOPE, may be effective for transfection in the presence of serum. For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vic al, La Jo 11a, California) and Lipofectamine (DOSPA) (Life Technology, Inc., Gaithersburg Md.).

Liposomal formulations may be particularly suited for topical administration, and may present an advantage over other formulations. Such advantages include reduced side effects related to high systemic absorption of the administered drug, increased accumulation of the administered drug at the desired target, and the ability to administer antisense oligonucleotide or siRNA, into the skin. In some implementations, liposomes are used for delivering antisense oligonucleotide or siRNA to epidermal cells and also to enhance the penetration of antisense oligonucleotide or siRNA into dermal tissues, e.g., into skin. For example, the liposomes can be applied topically.

In some embodiments, non-ionic liposomal systems are used to deliver an oligonucleotide to the skin, e.g., using non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) may be used to deliver an oligonucleotide. Such formulations with antisense oligonucleotide or siRNA are useful for treating a dermatological disorder.

Liposomes that include antisense oligonucleotide or siRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include antisense oligonucleotide or siRNA can be delivered, for example, subcutaneously by infection in order to deliver antisense oligonucleotide or siRNA to keratinocytes in the skin. In order to cross intact mammalian skin, lipid vesicles must pass through a series of fine pores, each with a diameter less than 50 nm, under the influence of a suitable trans dermal gradient. In addition, due to the lipid properties, these transferosomes can be self-optimizing (adaptive to the shape of pores, e.g., in the skin), self-repairing, and can frequently reach their targets without fragmenting, and often self-loading.

In some embodiments, an oligonucleotide is formulated with a surfactant. Surfactants find wide application in formulations such as emulsions (including microemulsions) and liposomes (see above). In some embodiments, the antisense oligonucleotide or siRNA is formulated as an emulsion that includes a surfactant. The most common way of classifying and ranking the properties of the many different types of surfactants, both natural and synthetic, is by the use of the hydrophile/lipophile balance (HLB). The nature of the hydrophilic group provides a useful means for categorizing the different surfactants used in formulations.

If the surfactant molecule is not ionized, it is classified as a nonionic surfactant. Nonionic surfactants find wide application in pharmaceutical products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxy ethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfo succinates, and phosphates. The most important members of the anionic surfactant class are the alkyl sulfates and the soaps. If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

Micelles and Other Membranous Formulations

For ease of exposition the micelles and other formulations, compositions and methods in this section are discussed largely with regard to unmodified antisense oligonucleotide or siRNA compounds. It may be understood, however, that these micelles and other formulations, compositions and methods can be practiced with other antisense oligonucleotide or siRNA compounds, e.g., modified antisense oligonucleotide or siRNA compounds. The antisense oligonucleotide or siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) composition can be provided as a micellar formulation. In some embodiments, "micelles" are a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the antisense oligonucleotide or siRNA composition, an alkali metal Cs to C22 alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxy ethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. In some cases, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

Pharmaceutical Compositions

In some embodiments, the composition is a pharmaceutical composition. In some embodiments, the composition is sterile. In some embodiments, the composition further comprises a pharmaceutically acceptable carrier.

In some embodiments, the pharmaceutically acceptable carrier comprises water. In some embodiments, the pharmaceutically acceptable carrier comprises a buffer. In some embodiments, the pharmaceutically acceptable carrier comprises a saline solution. In some embodiments, the pharmaceutically acceptable carrier comprises water, a buffer, or a saline solution. In some embodiments, the composition comprises a liposome. In some embodiments, the pharmaceutically acceptable carrier comprises liposomes, lipids, nanoparticles, proteins, protein-antibody complexes, peptides, cellulose, nanogel, or a combination thereof.

The oligonucleotides disclosed herein may be formulated in a pharmaceutical composition. The specific concentrations of the oligonucleotide can be determined by experimentation.

For ease of exposition the particles, formulations, compositions and methods in this section are discussed largely with regard to antisense oligonucleotide or siRNA compounds. It may be understood, however, that these particles, formulations, compositions and methods can be practiced with modified antisense oligonucleotide or siRNA compounds. In some embodiments, an antisense oligonucleotide or siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) preparations may be incorporated into a particle, e.g., a microparticle. Microparticles can be produced by spray-drying, but may also be produced by other methods including lyophilization, evaporation, fluid bed drying, vacuum drying, or a combination of these techniques.

The antisense oligonucleotide or siRNA agents may be formulated for pharmaceutical use. Pharmaceutically acceptable compositions comprise a therapeutically-effective amount of one or more of the antisense oligonucleotide or dsRNA agents in any of the preceding embodiments, taken alone or formulated together with one or more pharmaceutically acceptable carriers (additives), excipient and/or diluents.

The pharmaceutical compositions may be specially formulated for administration in solid or liquid form, including those adapted for the following: (1) oral administration, for example, drenches (aqueous or non-aqueous solutions or suspensions), tablets, e.g., those targeted for buccal, sublingual, and systemic absorption, boluses, powders, granules, pastes for application to the tongue; (2) parenteral administration, for example, by subcutaneous, intramuscular, intravenous or epidural injection as, for example, a sterile solution or suspension, or sustained-release formulation; (3) topical application, for example, as a cream, ointment, or a controlled-release patch or spray applied to the skin; (4) intravaginally or intrarectally, for example, as a pessary, cream or foam; (5) sublingually; (6) ocularly; (7) transdermally; (8) nasally; (9) inhalation; or (10) endotracheally.

In some embodiments, a "therapeutically-effective amount" is an amount of a compound, material, or composition comprising an oligonucleotide herein which is effective for producing some desired therapeutic effect in at least a sub-population of cells in an animal at a reasonable benefit/risk ratio applicable to any medical treatment.

In some embodiments, "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

In some embodiments, "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The formulations may conveniently be presented in unit dosage, or other relevant, form. The amount of active ingredient which can be combined with a carrier material to produce a single dosage form will vary depending upon the host being treated, the particular mode of administration. The amount of active ingredient which can be combined with a carrier material to produce a single dosage form will generally be that amount of the compound which produces a therapeutic effect. Generally, out of one hundred percent, this amount will range from about 0.1 percent to about ninety-nine percent of active ingredient, from about 5 percent to about 70 percent, or from about 10 percent to about 30 percent.

In certain embodiments, a formulation comprises an excipient selected from the group consisting of cyclodextrins, celluloses, liposomes, micelle forming agents, e.g., bile acids, and polymeric carriers, e.g., polyesters and polyanhydrides; and a compound disclosed herein. In certain embodiments, an aforementioned formulation renders orally bio available a compound disclosed herein.

An agent preparation can be formulated in combination with another agent, e.g., another therapeutic agent or an agent that stabilizes an antisense oligonucleotide or siRNA, e.g., a protein that complexes with antisense oligonucleotide or siRNA to form particle. Still other agents include chelators, e.g., EDTA (e.g., to remove divalent cations such as Mg2+), salts, RNAse inhibitors (e.g., a broad specificity RNAse inhibitor such as RNAsin) and so forth.

Methods of preparing these formulations or compositions include the step of bringing into association a compound disclosed herein with the carrier and, optionally, one or more accessory ingredients. In general, the formulations are prepared by uniformly and intimately bringing into association a compound disclosed herein with liquid carriers, or finely divided solid carriers, or both, and then, if necessary, shaping the product.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution which, in turn, may depend upon crystal size and crystalline form. In some cases, delayed absorption of a parenterally-administered drug form is accomplished by dissolving or suspending the drug in an oil vehicle.

The compounds disclosed herein may be formulated for administration in any convenient way for use in human or veterinary medicine, by analogy with other pharmaceuticals.

Further provided are pharmaceutical compositions of the oligonucleotide molecules described. These pharmaceutical compositions include salts of the above compounds, e.g., acid addition salts, for example, salts of hydrochloric, hydrobromic, acetic acid, and benzene sulfonic acid. These pharmaceutical formulations or pharmaceutical compositions can comprise a pharmaceutically acceptable carrier or diluent.

In some embodiments, pharmaceutical compositions (e.g. oligonucleotides and/or lipid nanoparticle formulations thereof) further comprise conventional pharmaceutical excipients and/or additives. Suitable pharmaceutical excipients include preservatives, flavoring agents, stabilizers, antioxidants, osmolality adjusting agents, buffers, and pH adjusting agents. Suitable additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

In some embodiments, the siRNA and LNP compositions and formulations provided herein for use in pulmonary delivery further comprise one or more surfactants. Suitable surfactants or surfactant components for enhancing the uptake of the compositions include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants can be used either as single or part of a multiple component surfactant in a formulation, or as covalently bound additions to the 5' and/or 3' ends of the nucleic acid component of a pharmaceutical composition herein.

Gene Therapy Vector

In some embodiments, double-stranded RNAi agents or antisense oligonucleotides are produced in a cell in vivo, e.g., from exogenous DNA templates that are delivered into the cell. For example, the DNA templates can be inserted into vectors and used as gene therapy vectors. Gene therapy vectors can be delivered to a subject by, for example, intravenous injection, local administration, or by stereotactic injection. The pharmaceutical preparation of the gene therapy vector can include the gene therapy vector in an acceptable diluent, or can comprise a slow release matrix in which the gene delivery vehicle is imbedded. The DNA templates, for example, can include two transcription units, one that produces a transcript that includes the top strand of a dsRNA agent and one that produces a transcript that includes the bottom strand of a dsRNA agent. When the templates are transcribed, the dsRNA agent is produced, and processed into siRNA agent fragments that mediate gene silencing.

Delivery Vehicles Based Upon Complexation of Nucleic Acid

In some embodiments, complexation of oligonucleotide therapeutics with cationic agents inhibits nuclease from degrading the oligonucleotide by forming a steric barrier and by inhibiting nuclease binding by neutralizing anionic charge. The process of forming compact particles of nucleic acids from their extended chains is called condensation, which may be achieved by the addition of multiply-charged cationic species. Multiple positive charges can either be covalently attached to one another in a polycation or non-covalently associated with one another in a complex such as the surface of a cationic liposome. The resulting polycation-poly anion interaction is a colloidal dispersion where the nucleic acid particles vary in size and shape depending on the nucleic acid and the condensing cation. In general, the particles are greater than 20 nm in size, and—in the absence of agents to modulate surface charge such as polyethylene glycol (PEG)—have surface charges >20 mV.

The pharmacokinetics and biodistribution of nanoparticles are dependent upon their size and charge. Upon iv administration, large (>200 nm) and/or highly positively charged (surface charge >20 mV) are primarily distributed among endothelial tissues and macrophages in the liver and spleen and have a half-life of circulation less than 2 hours. Reduction in size (<100 nm) and surface charge (~0 mV) results increased circulation times. Local administration of positively charged polyplexes results in association with cells at site of application such as epithelial cells.

Strategies for Cytoplasmic Delivery

There are a variety of strategies to facilitate cytoplasmic delivery of oligonucleotides including endosomal buffering (i.e. proton sponge), titratable amphiphiles, cell penetrating peptides and masked membrane lytic polymers.

The mechanism of endosomal buffering (i.e. proton sponge) to facilitate endosomolysis relies on the ability of agents such as polyamines to buffer endosomal/lysosomal compartments. The resistance to acidification is postulated to result in increased osmotic pressure that results in lysis of the lysosomal compartment. Titratable amphiphiles are polymers/peptides whose structure is pH-dependent in such a way that at acidic pH they are hydrophobic and membrane disruptive. Typically, titratable amphiphiles are polyanionic polymers or peptides with carboxylic acids that become neutral and membrane disruptive upon acidification. Cell penetrating peptides (CPPs) are cationic peptides, with a high propensity of guanidinium groups, that enter cells without any apparent membrane lysis. Masked lytic polymers are membrane disruptive polymers whose membrane interactivity is attenuated by reversible covalent modification. Like titratable amphiphiles, the mechanism of endosomolysis by masked polymers relies on the use of amphipathic polymers whose ability to lyse membranes is controlled such that the activity is only functional in the acidic environment of the endosome/lysosome. In the case of titratable amphiphiles, the mechanism of control is a reversible protonation of carboxylic acids. In the case of masked polymers, the control of membrane activity is the irreversible cleavage of a group that inhibits membrane interactivity of the polymer.

Liposomal Delivery Systems

Nucleic acids entrapped in lipids (lipoplexes) are a common vehicle for the delivery of nucleic acids. Cationic lipids form electrostatic complexes between nucleic acid and lipids. In addition to the cationic lipids, there are typically neutral or anionic helper lipids which include unsaturated fatty acids and are postulated to assist in fusion between the lipoplex and the cellular membrane, and PEGylated lipids, which prevent aggregation during formulation and storage and non-specific interactions in vivo.

Lipids are water insoluble and nucleic acids are organic solvent insoluble. To mix these components in a controlled manner such that formulations are repeatable and relatively homogenous in size, detergents or water-miscible organic solvents such as ethanol are used. After formation of electrostatically-associated complexes, the amphipathic detergent or solvent is then removed by dialysis or solvent exchange. Depending on the components and the mixing procedure is possible to formulate lipoplexes that are well less than 100 nm.

Although the transfection efficiencies of lipoplexes are difficult to predict and optimization is empirical, there are a few design features identified to aid transfection efficiency in vivo: pH-sensitive cationic lipids, the use of unsaturation in the lipid chains and the hydrophobic-hydrophilic balance of PEG-lipids to balance circulation times and transfection efficiencies.

There is a correlation between the pKa of the amine groups of the cationic lipid, which is buffer in the range of the endosomal/lysosomal pathway (pH 4-7), and transfection ability. To synthesize lipids with such pKa values, lipids commonly have closely-spaced amines or imidazole groups. The effect of these weakly basic amine groups in the lipoplexes produces several attractive attributes that facilitate in vivo transfection: reduced surface charge at neutral pH thereby decreasing nonspecific interactions in vivo, increased surface charge in acid environment of endosomes and lysosomes thereby increasing electrostatic interactions with the cellular membrane in these compartments and providing buffering groups that can provide endosomolytic activity via the proton sponge mechanism.

Another common motif observed in cationic and helper lipids used in lipoplexes is the presence of unsaturation in their component fatty acids with oleic (18 carbon chain with one double bond) and linoleic (18 carbons with 2 double bonds) being very common. The incorporation of these groups increases fluidity of membranes, aids in the formation of fusogenic lipid structures and facilitates the release of cationic lipids from nucleic acids.

PEG-conjugated lipids are incorporated into lipoplexes to aid in the formation of nonaggregating small complexes and for the prevention of nonspecific interactions in vivo. Due to the hydrophilicity of PEG, their lipid conjugates are not permanently associated with lipoplexes and diffuse from the complexes with dilution and interaction with amphiphilic components in vivo. This loss of PEG shielding from the surface of the lipoplexes aids in transfection efficiency. In general, longer saturated fatty acid chains increase circulation while unsaturation and shorter chains decrease circulation.

A commonly invoked tumor targeting mechanism is the Enhanced Permeability and Retention (EPR) effect, which is when nanoparticles accumulate in tumor tissue much more than they do in normal tissues due to the leaky disorganized vasculature associated with tumor tissues and their lack of lymphatic drainage. EPR-based targeting requires long circulating particles.

Polymer Based Delivery Vehicles

Like lipoplexes, polymer-based transfection vehicles (polyplexes) provide nuclease protection and condensation of larger nucleic acids. Polyplexes are based upon cationic polymers that form electrostatic complexes with anionic nucleic acids. Polycations may be purely synthetic (such as polyethyleneimine), naturally occurring (such as histones, protamine, spermine and spermidine) or synthetic polymers based upon cationic amino acids such as ornithine, lysine and arginine.

Polycations form electrostatic complexes with polyanionic nucleic acids. The strength of the association is dependent upon the size of the nucleic acid and the size and charge density of the polycation.

There are three common strategies to improve the stability and surface charge of polyplexes to improve the circulation and targeting of ability of polyplexes: crosslinking of polycation, addition of a synthetic polyanion and conjugation of PEG.

Crosslinking, also called lateral stabilization and caging, is the formation of covalent polyamine-polyamine bonds after complexation/condensation of the nucleic acid. The crosslinking is accomplished by the addition of bifunctional, amine-reactive reagents that form a 3-D network of bonds around the nucleic acid, thereby making the polyplex resistant to displacement by salts and polyelectrolytes. The stability of the polyplexes is such that the nucleic acid is no longer active unless a mechanism of reversibility is introduced to allow for release of the nucleic acid. A common way to introduce reversibility is the use of disulfide-containing crosslinking reagent that can be reduced in the cytoplasm allowing release of nucleic acid therapeutic.

A common method to reduce the surface charge of a polyplex is the conjugation of PEG, a method commonly known as steric stabilization. The resulting PEG modified polyplexes have prolonged circulation in vivo. PEG modifications can be added to the size chains of polyamines— either before or after polyplex formation- or at the end of the polymer as a block copolymer of PEG and polycation.

Crosslinking and PEGylation are often combined to make stabilized polyplexes of reduced surface charge for systemic administration that can either be passively or actively targeted. As observed for lipoplexes, a variety of small molecule (such as GalNAc, RGD and folate) and biologic targeting ligands (such as transferrin and antibodies) may be conjugated to PEG-modified polyplexes for tissues selective targeting.

The most commonly used polymer for polyplexes- and the originator of the proton sponge mechanism-is polyethylenimine (PEI). PEI's high density of amine groups endows it with high charge density and a continuum of amine pKa's that buffer in the entire pH range of the endosome. The buffering capacity of PEI may be mimicked by the addition of weakly basic imidazole groups.

Oligonucleotide vehicle formulation. The solution conditions in which the oligonucleotide is dissolved, or its delivery vehicle is dispersed may play a role in its delivery. Hypotonic and hypertonic solution conditions may aid in cytoplasmic delivery for systemic and locally administration.

Methods and Routes for Administration

In embodiments disclosed herein, the accumulation and/or expression of ANGPTL7 may be suppressed or inhibited by at least 10%. In embodiments disclosed herein, the ocular tissue cell is conjunctiva, sclera, trabecular meshwork (TM) or cornea. In certain embodiments, the ocular tissue is TM, such as human TM. In certain embodiments, the TM cell that is the subject may be located in vivo in a mammal.

Embodiments disclosed herein also provide a method of treating glaucoma in a patient in need thereof comprising administering to the patient an oligonucleotide in an amount sufficient to suppress accumulation of ANGPTL7 in an ocular tissue cell, wherein the RNA is a double-stranded molecule with a first strand of RNA that is a ribonucleotide sequence that corresponds to a nucleotide sequence encoding ANGPTL7 and a second strand of RNA that is a ribonucleotide sequence that is complementary to the nucleotide sequence encoding ANGPTL7, wherein the first and the second ribonucleotide strands are complementary strands that hybridize to each other to form the double-stranded molecule, and wherein the double-stranded molecule suppresses accumulation of ANGPTL7 in the ocular tissue cell. In certain embodiments, the ocular tissue cell may be conjunctiva, sclera, trabecular meshwork (TM) or cornea. In certain embodiments, the glaucoma is an open-angle glaucoma. In certain embodiments, the expression of ANGPTL7 or certain ANGPTL7 transcripts are inhibited by at least 10%.

Embodiments disclosed herein provide a method of making and identifying an isolated ANGPTL7-specific RNA that inhibits or modulates ANGPTL7 expression in a cell involving (a) generating an RNA that is a double-stranded molecule with a first strand of RNA that is a ribonucleotide sequence that corresponds to a nucleotide sequence encoding ANGPTL7 and a second strand of RNA that is a ribonucleotide sequence that is complementary to the nucleotide sequence encoding ANGPTL7, wherein the first and the second ribonucleotide strands are complementary strands that hybridize to each other to form the double-stranded molecule, and wherein the double-stranded molecule suppresses or modulates accumulation of ANGPTL7 or certain ANPTL7 transcripts in an ocular tissue cell; and (b) screening the RNA to determine whether the RNA inhibits or modulates ANGPTL7 expression in a cell. In certain embodiments, the ocular tissue cell is conjunctiva, sclera, trabecular meshwork (TM) or cornea. The ANGPTL7 transcripts may be inhibited or modulated by at least 10%, or may be inhibited or modulated by at least 50%, or may be inhibited or modulated by at least 80%. In certain embodiments, the RNA is introduced by topical administration.

Conditions mediated by ANGPTL7 activity include, but are not limited to glaucoma (including, for example, primary open-angle glaucoma, primary angle-closure glaucoma, normal-tension glaucoma, pigmentary glaucoma, exfoliation glaucoma, juvenile glaucoma, congenital glaucoma, inflammatory glaucoma, phacogenic glaucoma, glaucoma secondary to intraocular hemorrhage, traumatic glaucoma, neovascular glaucoma, drug-induced glaucoma, toxic glaucoma and absolute glaucoma), ocular hypertension, obesity, cancer, nevus sebaceous of Jadassohn, hepatitis C infection, osteoarthritis, keratoconus, fibrosis, hypoxia, abnormalities of lipid metabolism, oculocutaneous albinism, scleroderma, polymyositis, Crohn's disease, psoriasis, or rosacea. In some embodiments, the condition mediated by ANGPTL7 activity is an ocular condition. Ocular conditions include, but are not limited to, retinal artery occlusion, eyelid disease, panophthalmitis, ocular toxoplasmosis, angioid streaks, genetic eye tumor, retrobulbar hemorrhage, lacrimal gland adenoid cystic carcinoma, exfoliation syndrome, pharyngoconjunctival fever, takayasu arteritis, dry eye syndrome, macular holes, retinal vein occlusion, pterygium, vitreous body disease, ocular hypertension, retinopathy, cataract, ocular onchocerciasis, eye neoplasm, keratoconjunctivitis sicca, congenital nystagmus, genetic eye diseases, orbital myositis, glaucoma, optic neuritis, mixed cell uveal melanoma, uveitis, ocular tuberculosis, age-related macular degeneration, optic papillitis, eyelid neoplasm, ocular posterior capsular rupture, eye hemorrhage, eye injuries, ocular motility disease, corneal disease, acute retinal necrosis syndrome, eye infection, cycloplegia, microphthalmia, anterior uveitis, retinal drusen, diabetic eye disease, ocular foreign bodies, myopic macular degeneration, eye allergy, iritis, aniseikonia, retinal vasculitis, opsoclonus-myoclonus syndrome, ocular vascular disease, graves ophthalmopathy, lens disease, Sjogren syndrome, macular degeneration, or cytomegalovirus retinitis.

Routes of Delivery

A composition that includes an antisense oligonucleotide or dsRNA agent can be delivered to a subject by a variety of routes. Exemplary routes include: intravenous, subcutaneous, topical, rectal, anal, vaginal, nasal, endotracheally, inhalation, pulmonary, ocular.

In one embodiment, a patient is prophylactically or therapeutically administered an agent that reduces or modulates the expression of ANGPTL7. The inventive method may prevent or delay an increase in intraocular pressure, may reduce associated nerve loss, may confer protection on retinal sensory cells, etc. Administration may be by any ocular route. One example is topical application, with the ANGPTL7 reducing agent administered in a formulation of eye drops, cream, ointment, gel, salve, etc. Another example is intraocular injection with the ANGPTL7 reducing agent administered subconjunctivally, intravitreally, retrobulbarly, within the crystalline lens via piercing the lens capsule. Another example provides the ANGPTL7 reducing or modulating agent to the eye on or in a formulation such as a liposome, microsphere, microcapsule, biocompatible matrix, gel, polymer, nanoparticle, nanocapsule, etc. Another example provides the ANGPTL7 reducing or modulating agent on or in a device such as a device for transscleral delivery, or another intraocular device using, for example, iontophoresis or another type of release mechanism (controlled or not controlled), as known by one skilled in the art. Another example provides the ANGPTL7 reducing or modulating agent in conjunction with gene therapy, as known by one skilled in the art.

The antisense oligonucleotide or dsRNA agent can be incorporated into pharmaceutical compositions suitable for administration. Such compositions typically include one or more species of antisense oligonucleotide or dsRNA agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

In embodiments, the pharmaceutical compositions described herein can be formulated for oral, parental, intramuscular, transdermal, intravenous, inter-arterial, nasal, vaginal, sublingual, and subungual. Further, the route also includes, but is not limited to auricular, buccal, conjunctival, cutaneous, dental, electro-osmosis, endocervical, endosinusial, endotracheal, enteral, epidural, extra-amniotic, extra-corporeal, hemodialysis, infiltration, interstitial, intra-abdominal, intra-amniotic, intra-arterial, intra-articular, intrabiliary, intrachronchial, intrabursal, intracardiac, intra-cartilagenous, intracaudal, mtracavernous, intracavitary, intracerebral, intraci sternal, intracomeal, intracoronaiy, intracorporus cavernosum, intradermal, intradiscal, intraducatal, intraduodenal, intradural, intraepidermal, mtraesophageal, intragastric, intragingival, intraileal, intralesional, intralumical, intralymphatic, intramedullary, intrameningeal, intraocular, intraovarian, mtrapericardial, intraperitoneal, intrapleural, intrapulmonary, intrasinal, intrasynovial, intratendinous, intratesticular, intrathec al, intrathoracic, intratubular, intratumor, intratympanic, intrauterine, intravascular, intravenous bolus, intravenous drip, intraventricular, intravesical, intravitreal, iontophoresis, irrigation, laryngeal, nasal, nasogastric, occlusive dressing technique, ophthalmic, orophaiyngeal, percutaneous, periarticular, peridural, periodontal, rectal, respirator}-, retrobulbar, soft tissue, subarachnoid, subconjunctival, subcutaneous, submucosal, topical, transmucosal, transplacental, transtracheal, transtympanic, ureteral, or urethal. In particular embodiments, the pharmaceutical compositions are formulated for intraocular administration, e.g., intravitreal, or topical.

The route and site of administration may be chosen to enhance targeting. For example, to target muscle cells, intramuscular injection into the muscles of interest would be a logical choice. Lung cells might be targeted by administering the antisense oligonucleotide or dsRNA agent in aerosol form.

Exemplary formulations for topical administration include those in which the antisense oligonucleotides or dsRNAs are in admixture with a topical delivery agent such as lipids, liposomes, fatty acids, fatty acid esters, steroids, chelating agents and surfactants. Exemplary lipids and liposomes include neutral (e.g. dioleoyl-phosphatidyl DOPE etlianolaniine, dimyristoylphosphatidyl choline DMPC, distearolyphosphatidyl choline) negative (e.g. dimyristoylphosphatidyl glycerol DMPG) and cationic (e.g. dioleoyltetramemylaminopropyl DOTAP and dioleoylphosphatidyl ethanolamine DOTMA).

For topical or other administration, antisense oligonucleotides or dsRNAs may be encapsulated within liposomes or may form complexes thereto, in particular to cationic liposomes. In some cases, antisense oligonucleotides or dsRNAs may be complexed to lipids, in particular to cationic lipids.

A topical formulation may be administered by any ophthalmogical vehicle, as know to one skilled in the art. Examples include, but are not limited to, eye droppers, satchels, applicators, etc. The amount and concentration of the formulation may depend upon the diluent, delivery system or device selected, clinical condition of the patient, side effects expected, stability of the compounds of the composition, presence and severity of other pathology, dosing frequency, active agent, etc.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Exemplary surfactants include fatty acids and or esters or salts thereof, bile acids and/or salts thereof. In some cases, penetration enhancers, for example, fatty acids salts are combined with bile acids salts. An exemplary combination is the sodium salt of lauric acid, capric acid and UDCA. Further penetration enhancers include polyoxyethylene-9-lauryl ether, polyoxyethylene-20-cetyl ether. Oligonucleotides may be delivered orally, in granular form including sprayed dried particles, or complexed to form micro or nanoparticles.

Compositions and formulations for pulmonary administration may include sterile aqueous solutions that may also contain buffers, diluents and other suitable additives such as, but not limited to, penetration enhancers, carrier compounds and other pharmaceutically acceptable carriers or excipients.

Dosage

In one aspect, provided is a method of administering an antisense oligonucleotide or dsRNA agent to a subject (e.g., a human subject). The method includes administering a unit dose of the antisense oligonucleotide or dsRNA agent that is 14-30 nucleotides (nt) long, for example, 21-23 nt, and is complementary to a target RNA (e.g., ANGPTL7), and optionally includes at least one 3' overhang 1-5 nucleotide long.

For topical administration, examples of concentrations that may be used include but are not limited to, less than 1 μg/mL, 1 μg/mL to 5 μg/mL, 5 μg/mL to 10 μg/mL, 10 μg/mL to 50 μg/mL, 50 μg/mL to 100 μg/mL, 100 μg/mL to 0.5 mg/mL, 0.5 mg/mL to 2.5 mg/mL, 1 mg/mL to 5 mg/mL, 5 mg/mL to 10 mg/mL, 10 mg/mL to 15 mg/mL, 15 mg/mL to 30 mg/mL, and greater than 30 mg/mL. For topical administration, examples of dosing regimens that may be used include but are not limited to, hourly, half-daily, daily, weekly, biweekly, monthly, quarterly, three times a year, twice a year, yearly, every two years, every three years, etc. Intervals between doses may be regular or varied. As one example, doses may be administered hourly or daily pre- and post-surgery for one week, for several weeks, or for several months, then may be administered twice a year or once a year until the desired reduction in intraocular pressure is achieved. As another example, doses may be administered daily or weekly pre- and/or post-surgery for one week, for several weeks, for several months, or for several years until the desired reduction in intraocular pressure achieved.

The defined amount can be an amount effective to treat or prevent a disease or disorder, e.g., a disease or disorder associated with the target RNA. The unit dose, for example, can be administered by injection (e.g., intravenous, subcutaneous or intramuscular), an inhaled dose, or a topical application. In some embodiments dosages may be less than 10, 5, 2, 1, or 0.1 mg/kg of body weight.

In some embodiments, the unit dose is administered less frequently than once a day, e.g., less than every 2, 4, 8 or 30 days. In some embodiments, the unit dose is not administered with a frequency {e.g., not a regular frequency). For example, the unit dose may be administered a single time.

In some embodiments, the effective dose is administered with other traditional therapeutic modalities. For example, a therapeutic agent useful for treating a disease or disorder affecting the eye.

In some embodiments, a subject is administered an initial dose and one or more maintenance doses of an antisense oligonucleotide or dsRNA agent. The maintenance dose or doses can be the same or lower than the initial dose, e.g., one-half less of the initial dose. A maintenance regimen can include treating the subject with a dose or doses ranging from 0.01 μg to 15 mg/kg of body weight per day, e.g., 10, 1, 0.1, 0.01, 0.001, or 0.00001 mg per kg of bodyweight per day. The maintenance doses are, for example, administered no more than once every 2, 5, 10, or 30 days. Further, the treatment regimen may last for a period of time which will vary depending upon the nature of the particular disease, its severity and the overall condition of the patient. In certain embodiments the dosage may be delivered no more than once per day, e.g., no more than once per 24, 36, 48, or more hours, e.g., no more than once for every 5 or 8 days.

Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state is ablated, or if undesired side-effects are observed. The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

The antisense oligonucleotide or dsRNA agents can be administered to mammals, particularly large mammals such as nonhuman primates or humans in a number of ways.

In some embodiments, the administration of the antisense oligonucleotide or dsRNA agent is parenteral, e.g., intravenous (e.g., as a bolus or as a diffusible infusion), intradermal, intraperitoneal, intramuscular, intrathec al, intraventricular, intracranial, subcutaneous, transmucosal, buccal, sublingual, endoscopic, rectal, oral, vaginal, topical, inhalation, pulmonary, intranasal, urethral or ocular. Administration can be provided by the subject or by another person, e.g., a health care provider. The medication can be provided in measured doses or in a dispenser which delivers a metered dose. Selected modes of delivery are discussed elsewhere herein.

Methods and Uses

Disclosed herein, in some embodiments, are methods of administering a composition described herein to a subject. Some embodiments relate to use a composition described herein, such as administering the composition to a subject. In some embodiments, the administration comprises an injection.

Some embodiments relate to a method of treating a disorder in a subject in need thereof. Some embodiments relate to use of a composition described herein in the method of treatment. Some embodiments include administering a composition described herein to a subject with the disorder.

In some embodiments, the administration treats the disorder in the subject. In some embodiments, the composition treats the disorder in the subject.

In some embodiments, the treatment comprises prevention, inhibition, or reversion of the disorder in the subject. Some embodiments relate to use of a composition described herein in the method of preventing, inhibiting, or reversing the disorder. Some embodiments relate to a method of preventing, inhibiting, or reversing a disorder a disorder in a subject in need thereof. Some embodiments include administering a composition described herein to a subject with the disorder. In some embodiments, the administration prevents, inhibits, or reverses the disorder in the subject. In some embodiments, the composition prevents, inhibits, or reverses the disorder in the subject.

Some embodiments relate to a method of preventing a disorder a disorder in a subject in need thereof. Some embodiments relate to use of a composition described herein in the method of preventing the disorder. Some embodiments include administering a composition described herein to a subject with the disorder. In some embodiments, the administration prevents the disorder in the subject. In some embodiments, the composition prevents the disorder in the subject.

Some embodiments relate to a method of inhibiting a disorder a disorder in a subject in need thereof. Some embodiments relate to use of a composition described herein in the method of inhibiting the disorder. Some embodiments include administering a composition described herein to a subject with the disorder. In some embodiments, the administration inhibits the disorder in the subject. In some embodiments, the composition inhibits the disorder in the subject.

Some embodiments relate to a method of reversing a disorder a disorder in a subject in need thereof. Some embodiments relate to use of a composition described herein in the method of reversing the disorder. Some embodiments include administering a composition described herein to a subject with the disorder. In some embodiments, the administration reverses the disorder in the subject. In some embodiments, the composition reverses the disorder in the subject.

In some embodiments, the administration comprises an injection. In some embodiments, the administration is to an eye. In some embodiments, the administration is intravenous.

Disorders

Some embodiments of the methods described herein include treating a disorder in a subject in need thereof. In some embodiments, the disorder is or includes a disorder with high ANGPTL7 expression. In some embodiments, the disorder is an eye disorder. In some embodiments, the disorder comprises a disorder associated with high intraocular pressure. In some embodiments, the disorder is glaucoma. In some embodiments, the glaucoma is a glaucoma subtype. In some embodiments, the glaucoma subtype is non-specific glaucoma. In some embodiments, the glaucoma subtype is primary open angle glaucoma (POAG). In some embodiments, the glaucoma subtype is primary angle closure glaucoma (PACG). In some embodiments, the glaucoma includes a glaucoma symptom. In some embodiments, the glaucoma symptom includes an intraocular pressure measurement. In some embodiments, the glaucoma symptom includes need for a glaucoma surgery. In some embodiments, the glaucoma symptom includes need for a glaucoma medication.

Subjects

Some embodiments of the methods described herein include treatment of a subject. Examples of subjects include vertebrates, animals, mammals, dogs, cats, cattle, rodents, mice, rats, primates, monkeys, and humans. In some embodiments, the subject is a vertebrate. In some embodiments, the subject is an animal. In some embodiments, the subject is a mammal. In some embodiments, the subject is a dog. In some embodiments, the subject is a cat. In some embodiments, the subject is a cattle. In some embodiments, the subject is a mouse. In some embodiments, the subject is a rat. In some embodiments, the subject is a primate. In some embodiments, the subject is a monkey. In some embodiments, the subject is an animal, a mammal, a dog, a cat, cattle, a rodent, a mouse, a rat, a primate, or a monkey. In some embodiments, the subject is a human.

Baseline Measurements

Some embodiments of the methods described herein include obtaining a baseline measurement from a subject. For example, in some embodiments, a baseline measurement is obtained from the subject prior to treating the subject. In some embodiments, the baseline measurement comprises a baseline pressure measurement. In some embodiments, the baseline measurement is a baseline intraocular pressure measurement. In some embodiments, the baseline measurement is incidence of glaucoma. In some embodiments, the baseline measurement is incidence of a glaucoma subtype. In some embodiments, the baseline measurement is incidence of a glaucoma symptom.

In some embodiments, the baseline measurement is obtained by performing an assay such as an immunoassay, a colorimetric assay, or a fluorescence assay, on the sample obtained from the subject. In some embodiments, the baseline measurement is obtained by an immunoassay, a colorimetric assay, or a fluorescence assay. In some embodiments, the baseline measurement is obtained by PCR.

In some embodiments, the baseline measurement is a baseline ANGPTL7 protein measurement. In some embodiments, the baseline ANGPTL7 protein measurement comprises a baseline ANGPTL7 protein level. In some embodiments, the baseline ANGPTL7 protein level is indicated as a mass or percentage of ANGPTL7 protein per sample weight. In some embodiments, the baseline ANGPTL7 protein level is indicated as a mass or percentage of ANGPTL7 protein per sample volume. In some embodiments, the baseline ANGPTL7 protein level is indicated as a mass or percentage of ANGPTL7 protein per total protein within the sample. In some embodiments, the baseline ANGPTL7 protein measurement is a baseline circulating ANGPTL7 protein measurement. In some embodiments, the baseline ANGPTL7 protein measurement is obtained by an assay such as an immunoassay, a colorimetric assay, or a fluorescence assay.

In some embodiments, the baseline measurement is a baseline ANGPTL7 mRNA measurement. In some embodiments, the baseline ANGPTL7 mRNA measurement comprises a baseline ANGPTL7 mRNA level. In some embodiments, the baseline ANGPTL7 mRNA level is indicated as a mass or percentage of ANGPTL7 mRNA per sample weight. In some embodiments, the baseline ANGPTL7 mRNA level is indicated as a mass or percentage of ANGPTL7 mRNA per sample volume. In some embodiments, the baseline ANGPTL7 mRNA level is indicated as a mass or percentage of ANGPTL7 mRNA per total mRNA within the sample. In some embodiments, the baseline ANGPTL7 mRNA level is indicated as a mass or percentage of ANGPTL7 mRNA per total nucleic acids within the sample. In some embodiments, the baseline ANGPTL7 mRNA level is indicated relative to another mRNA level, such as an mRNA level of a housekeeping gene, within the sample. In some embodiments, the baseline ANGPTL7 mRNA measurement is obtained by an assay such as a polymerase chain reaction (PCR) assay. In some embodiments, the PCR comprises quantitative PCR (qPCR). In some embodiments, the PCR comprises reverse transcription of the ANGPTL7 mRNA Some embodiments of the methods described herein include obtaining a sample from a subject. In some embodiments, the baseline measurement is obtained in a sample obtained from the subject. In some embodiments, the sample is obtained from the subject prior to administration or treatment of the subject with a composition described herein. In some embodiments, a baseline measurement is obtained in a sample obtained from the subject prior to administering the composition to the subject. In some embodiments, the sample comprises ocular or eye tissue.

In some embodiments, the sample comprises a fluid. In some embodiments, the sample is a fluid sample. In some embodiments, the sample is a blood, plasma, or serum sample. In some embodiments, the fluid comprises an eye fluid. In some embodiments, the fluid comprises an intraocular fluid.

In some embodiments, the baseline measurement is obtained noninvasively. In some embodiments, the baseline measurement is obtained directly from the subject.

Effects

In some embodiments, the composition or administration of the composition affects a measurement such as a pressure measurement, an intraocular pressure measurement, incidence of glaucoma, incidence of a glaucoma subtype, or incidence of a glaucoma symptom, relative to the baseline measurement. In some embodiments, the measurement is an intraocular pressure measurement.

Some embodiments of the methods described herein include obtaining the measurement from a subject. For example, the measurement may be obtained from the subject after treating the subject. In some embodiments, the measurement is obtained in a second sample (such as a fluid or tissue sample described herein) obtained from the subject after the composition is administered to the subject. In some embodiments, the measurement is an indication that the disorder has been treated.

In some embodiments, the measurement is obtained by an assay as described herein. For example, the assay may comprise an immunoassay, a colorimetric assay, a fluorescence assay, or a PCR assay.

In some embodiments, the measurement is obtained within 1 week, within 2 weeks, within 3 weeks, within 1 month, within 2 months, within 3 months, within 6 months, within 1 year, within 2 years, within 3 years, within 4 years, or within 5 years after the administration of the composition. In some embodiments, the measurement is obtained after 1 week, after 2 weeks, after 3 weeks, after 1 month, after 2 months, after 3 months, after 6 months, after 1 year, after 2 years, after 3 years, after 4 years, or after 5 years, following the administration of the composition.

In some embodiments, the composition reduces the measurement relative to the baseline measurement. In some embodiments, the reduction is measured in a second tissue sample obtained from the subject after administering the composition to the subject. In some embodiments, the reduction is measured directly in the subject after administering the composition to the subject. In some embodiments, the measurement is decreased by about 2.5% or more, about 5% or more, or about 7.5% or more, relative to the baseline measurement. In some embodiments, the measurement is decreased by about 10% or more, relative to the baseline measurement. In some embodiments, the measurement is decreased by about 20% or more, about 30% or more, about 40% or more, about 50% or more, about 60% or more, about 70% or more, about 80% or more, about 90% or more, relative to the baseline measurement. In some embodiments, the measurement is decreased by no more than about 2.5%, no more than about 5%, or no more than about 7.5%, relative to the baseline measurement. In some embodiments, the measurement is decreased by no more than about 10%, relative to the baseline measurement. In some embodiments, the measurement is decreased by no more than about 20%, no more than about 30%, no more than about 40%, no more than about 50%, no more than about 60%, no more than about 70%, no more than about 80%, no more than about 90%, or no more than about 100% relative to the baseline measurement. In some embodiments, the measurement is decreased by 2.5%, 5%, 7.5%, 10%, 20%, 30%, 40%, 50%, 60%, 70%, 80%, 90%, or 100%, or by a range defined by any of the two aforementioned percentages.

In some embodiments, the measurement is an ANGPTL7 protein measurement. In some embodiments, the ANGPTL7 protein measurement comprises an ANGPTL7 protein level. In some embodiments, the ANGPTL7 protein level is indicated as a mass or percentage of ANGPTL7 protein per sample weight. In some embodiments, the ANGPTL7 protein level is indicated as a mass or percentage of ANGPTL7 protein per sample volume. In some embodiments, the ANGPTL7 protein level is indicated as a mass or percentage of ANGPTL7 protein per total protein within the sample. In some embodiments, the ANGPTL7 protein measurement is a circulating ANGPTL7 protein measurement. In some embodiments, the baseline ANGPTL7 protein measurement is obtained by an assay such as an immunoassay, a colorimetric assay, or a fluorescence assay.

In some embodiments, the composition reduces the ANGPTL7 protein measurement relative to the baseline ANGPTL7 protein measurement. In some embodiments, the composition reduces circulating ANGPTL7 protein levels relative to the baseline ANGPTL7 protein measurement. In some embodiments, the composition reduces tissue ANGPTL7 protein levels (such as ocular ANGPTL7 protein levels) relative to the baseline ANGPTL7 protein measurement. In some embodiments, the reduced ANGPTL7 protein levels are measured in a second sample obtained from the subject after administering the composition to the subject.

In some embodiments, the ANGPTL7 protein measurement is decreased by about 2.5% or more, about 5% or more, or about 7.5% or more, relative to the baseline ANGPTL7 protein measurement. In some embodiments, the ANGPTL7 protein measurement is decreased by about 10% or more, relative to the baseline ANGPTL7 protein measurement. In some embodiments, the ANGPTL7 protein measurement is decreased by about 20% or more, about 30% or more, about 40% or more, about 50% or more, about 60% or more, about 70% or more, about 80% or more, about 90% or more, or about 100% or more relative to the baseline ANGPTL7 protein measurement. In some embodiments, the ANGPTL7 protein measurement is decreased by no more than about 2.5%, no more than about 5%, or no more than about 7.5%, relative to the baseline ANGPTL7 protein measurement. In some embodiments, the ANGPTL7 protein measurement is decreased by no more than about 10%, relative to the baseline ANGPTL7 protein measurement. In some embodiments, the ANGPTL7 protein measurement is decreased by no more than about 20%, no more than about 30%, no more than about 40%, no more than about 50%, no more than about 60%, no more than about 70%, no more than about 80%, no more than about 90%, or no more than about 100% relative to the baseline ANGPTL7 protein measurement. In some embodiments, the ANGPTL7 protein measurement is decreased by 2.5%, 5%, 7.5%, 19%, 20%, 30%, 40%, 50%, 60%, 70%, 80%, 90%, 100%, or by a range defined by any of the two aforementioned percentages.

In some embodiments, the measurement is an ANGPTL7 mRNA measurement. In some embodiments, the ANGPTL7 mRNA measurement comprises an ANGPTL7 mRNA level. In some embodiments, the ANGPTL7 mRNA level is indicated as a mass or percentage of ANGPTL7 mRNA per sample weight. In some embodiments, the ANGPTL7 mRNA level is indicated as a mass or percentage of ANGPTL7 mRNA per sample volume. In some embodiments, the ANGPTL7 mRNA level is indicated as a mass or percentage of ANGPTL7 mRNA per total mRNA within the sample. In some embodiments, the ANGPTL7 mRNA level is indicated as a mass or percentage of ANGPTL7 mRNA per total nucleic acids within the sample. In some embodiments, the ANGPTL7 mRNA level is indicated relative to another mRNA level, such as an mRNA level of a housekeeping gene, within the sample. In some embodiments, the ANGPTL7 mRNA measurement is obtained by an assay such as a PCR assay. In some embodiments, the PCR comprises qPCR. In some embodiments, the PCR comprises reverse transcription of the ANGPTL7 mRNA In some embodiments, the composition reduces the ANGPTL7 mRNA measurement relative to the baseline ANGPTL7 mRNA measurement. In some embodiments, the ANGPTL7 mRNA measurement is obtained in a second sample obtained from the subject after administering the composition to the subject. In some embodiments, the composition reduces ANGPTL7 mRNA levels relative to the baseline ANGPTL7 mRNA levels. In some embodiments, the reduced ANGPTL7 mRNA levels are measured in a second sample obtained from the subject after administering the composition to the subject. In some embodiments, the second sample is an ocular sample.

In some embodiments, the ANGPTL7 mRNA measurement is reduced by about 2.5% or more, about 5% or more, or about 7.5% or more, relative to the baseline ANGPTL7 mRNA measurement. In some embodiments, the ANGPTL7 mRNA measurement is decreased by about 10% or more, relative to the baseline ANGPTL7 mRNA measurement. In some embodiments, the ANGPTL7 mRNA measurement is decreased by about 20% or more, about 30% or more, about 40% or more, about 50% or more, about 60% or more, about 70% or more, about 80% or more, about 90% or more, or about 100% or more relative to the baseline ANGPTL7 mRNA measurement. In some embodiments, the ANGPTL7 mRNA measurement is decreased by no more than about 2.5%, no more than about 5%, or no more than about 7.5%, relative to the baseline ANGPTL7 mRNA measurement. In some embodiments, the ANGPTL7 mRNA measurement is decreased by no more than about 10%, relative to the baseline ANGPTL7 mRNA measurement. In some embodiments, the ANGPTL7 mRNA measurement is decreased by no more than about 20%, no more than about 30%, no more than about 40%, no more than about 50%, no more than about 60%, no more than about 70%, no more than about 80%, no more than about 90%, or no more than about 100% relative to the baseline ANGPTL7 mRNA measurement. In some embodiments, the ANGPTL7 mRNA measurement is decreased by 2.5%, 5%, 7.5%, 10%, 20%, 30%, 40%, 50%, 60%, 70%, 80%, 90%, 100%, or by a range defined by any of the two aforementioned percentages.

Methods of Inhibiting or Modulating Expression of the Target Gene

Embodiments also relate to methods for inhibiting the expression of a target gene. The method comprises the step of administering the antisense oligonucleotide or dsRNA agents in any of the preceding embodiments, in an amount sufficient to inhibit expression of the target gene. In some embodiments, the target gene is ANGPTL7. Another aspect relates to a method of modulating the expression of a target gene in a cell, comprising providing to said cell an antisense oligonucleotide or dsRNA agent. In some embodiments, the target gene is ANGPTL7. In some embodiments, the antisense oligonucleotide or dsRNA agent described herein is modified.

The present disclosure provides vitro and in vivo methods for treatment of a disease or disorder in a mammal by downregulating or silencing the transcription and/or translation of a target gene or gene transcript of interest. In some embodiments, the method comprises introducing an antisense oligonucleotide or dsRNA agent that silences expression (e.g., mRNA and/or protein levels) of a target sequence into a cell by contacting the cell with a modified antisense oligonucleotide or dsRNA agent described herein. In some embodiments, the method comprises in vivo delivery of an antisense oligonucleotide or dsRNA agent that silences expression of a target sequence by administering to a mammal a modified antisense oligonucleotide or dsRNA described herein. Administration of the antisense oligonucleotide or dsRNA can be by any route known in the art, such as, e.g., oral, intranasal, inhalation, intravenous, intraperitoneal, intramuscular, intra-articular, intralesional, intratracheal, endotracheal, subcutaneous, or intradermal. In some cases, delivery is by respiratory tract administration. In some embodiments, the target sequence is ANGPTL7.

In certain embodiments, the antisense oligonucleotide or dsRNA agent comprises a carrier system, e.g., to deliver the antisense oligonucleotide or dsRNA agent into a cell of a mammal. Non-limiting examples of carrier systems include nucleic acid-lipid particles, liposomes, micelles, virosomes, nucleic acid complexes, and mixtures thereof. In certain instances, the antisense oligonucleotide or dsRNA molecule is complexed with a lipid such as a cationic lipid to form a lipoplex. In certain instances, the antisense oligonucleotide or dsRNA agent is complexed with a polymer such as a cationic polymer (e.g., polyethylenimine (PEI)) to form a polyplex. The antisense oligonucleotide or dsRNA agent may also be complexed with cyclodextrin or a polymer thereof. In some embodiments, the antisense oligonucleotide or dsRNA agent is encapsulated in a nucleic acid-lipid particle.

Assessing Up-Regulation or Inhibition of Gene or Transcript Expression

Transfer of an exogenous nucleic acid into a host cell or organism can be assessed by directly detecting the presence of the nucleic acid in the cell or organism. For example, the presence of the exogenous nucleic acid can be detected by Southern blot or by a polymerase chain reaction (PCR) technique using primers that specifically amplify nucleotide sequences associated with the nucleic acid. Expression of the exogenous nucleic acids can also be measured using conventional methods including gene expression analysis. For instance, mRNA produced from an exogenous nucleic acid can be detected and quantified using a Northern blot and reverse transcription PCR (RT-PCR).

Expression of RNA from the exogenous nucleic acid can also be detected by measuring an enzymatic activity or a reporter protein activity. For example, antisense or dsRNA modulatory activity can be measured indirectly as a decrease or increase in target nucleic acid expression as an indication that the exogenous nucleic acid is producing the effector RNA. Based on sequence conservation, primers can be designed and used to amplify coding regions of the target genes. Initially, the most highly expressed coding region from each gene can be used to build a model control gene, although any coding or non-coding region can be used. Each control gene is assembled by inserting each coding region between a reporter coding region and its poly(A) signal. These plasmids would produce an mRNA with a reporter gene in the upstream portion of the gene and a potential RNAi target in the 3' non-coding region. The effectiveness of individual antisense oligonucleotides or dsRNA would be assayed by modulation of the reporter gene. Reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), red fluorescent protein (RFP), yellow fluorescent protein (YFP), cyan fluorescent protein (CFP), horseradish peroxidase (HRP), luciferase (Lac), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracycline. Methods to determine modulation of a reporter gene are well known in the art, and include, but are not limited to, fluorometric methods (e.g. fluorescence spectroscopy, Fluorescence Activated Cell Sorting (FACS), fluorescence microscopy), antibiotic resistance determination.

ANGPTL7 protein and mRNA expression can be assayed using for example, immunoassays such as the ELISA to measure protein levels.

In some embodiments, ANGPTL7 expression (e.g., mRNA or protein) in a sample (e.g., cells or tissues in vivo or in vitro) treated using an antisense oligonucleotide or dsRNA agent is evaluated by comparison with ANGPTL7 expression in a control sample. For example, expression of the protein or nucleic acid can be compared using a mock-treated or untreated sample. In some cases, comparison with a sample treated with a control antisense oligonucleotide (e.g., one having an altered or different sequence) can be made depending on the information desired. In some embodiments, a difference in the expression of the ANGPTL7 protein or nucleic acid in a treated vs. an untreated sample can be compared with the difference in expression of a different nucleic acid (including any standard deemed appropriate by the researcher, e.g., a housekeeping gene) in a treated sample vs. an untreated sample.

Observed differences can be expressed as desired, e.g., in the form of a ratio or fraction, for use in a comparison with control. In embodiments, the level of ANGPTL7 mRNA or protein, in a sample treated with an antisense oligonucleotide or dsRNA, is increased or decreased by about 1.25-fold to about 10-fold or more relative to an untreated sample or a sample treated with a control nucleic acid. In embodiments, the level of ANGPTL7 mRNA or protein is increased or decreased by at least about 1.25-fold, at least about 1.3-fold, at least about 1.4-fold, at least about 1.5-fold, at least about 1.6-fold, at least about 1.7-fold, at least about 1.8-fold, at least about 2-fold, at least about 2.5-fold, at least about 3-fold, at least about 3.5-fold, at least about 4-fold, at least about 4.5-fold, at least about 5-fold, at least about 5.5-fold, at least about 6-fold, at least about 6.5-fold, at least about 7-fold, at least about 7.5-fold, at least about 8-fold, at least about 8.5-fold, at least about 9-fold, at least about 9.5-fold, or at least about 10-fold or more.

Kits, Research Reagents, Diagnostics, and Therapeutics

The compounds disclosed herein can be utilized for diagnostics, therapeutics, and prophylaxis, and as research reagents and components of kits. Furthermore, antisense oligonucleotides or dsRNA, which inhibit gene expression may be used to elucidate the function of particular genes or to distinguish between functions of various members of a biological pathway.

For use in kits and diagnostics and in various biological systems, the compounds disclosed herein, either alone or in combination with other compounds or therapeutics, may be useful as tools in differential and/or combinatorial analyses to elucidate expression patterns of a portion or the entire complement of genes expressed within cells and tissues.

In some embodiments, the term "biological system" or "system" is any organism, cell, cell culture or tissue that expresses, or is made competent to express products of the angiopoietin like 7 (ANGPTL7) genes. These include, but are not limited to, humans, transgenic animals, cells, cell cultures, tissues, xenografts, transplants and combinations thereof.

As one non limiting example, expression patterns within cells or tissues treated with one or more antisense compounds or dsRNAs are compared to control cells or tissues not treated with antisense compounds or dsRNAs and the patterns produced are analyzed for differential levels of gene expression as they pertain, for example, to disease association, signaling pathway, cellular localization, expression level, size, structure or function of the genes examined. These analyses can be performed on stimulated or unstimulated cells and in the presence or absence of other compounds that affect expression patterns.

Examples of methods of gene expression analysis include DNA arrays or microarrays, SAGE (serial analysis of gene expression), READS (restriction enzyme amplification of digested cDNAs), TOGA (total gene expression analysis), protein arrays and proteomics, expressed sequence tag (EST) sequencing, subtractive RNA fingerprinting (SuRF), subtractive cloning, differential display (DD), comparative genomic hybridization, FISH (fluorescent in situ hybridization) techniques and mass spectrometry methods.

In some embodiments, the compounds disclosed herein are useful for research and diagnostics, because these compounds hybridize to nucleic acids encoding angiopoietin like 7 (ANGPTL7). For example, oligonucleotides that hybridize with such efficiency and under such conditions as disclosed herein as to be effective ANGPTL7 modulators are effective primers or probes under conditions favoring gene amplification or detection, respectively. These primers and probes are useful in methods requiring the specific detection of nucleic acid molecules encoding ANGPTL7 and in the amplification of said nucleic acid molecules for detection or for use in further studies of ANGPTL7. Hybridization of the antisense oligonucleotides, particularly the primers and probes, with a nucleic acid encoding ANGPTL7 can be detected, e.g., by conjugation of an enzyme to the oligonucleotide, radiolabeling of the oligonucleotide, or any other suitable detection means. Kits using such detection means for detecting the level of ANGPTL7 in a sample may also be prepared.

The specificity and sensitivity of antisense and sRNA are also harnessed for therapeutic uses. For therapeutics, an animal, e.g., a human, suspected of having a disease or disorder which can be treated by modulating the expression of ANGPTL7 polynucleotides is treated by administering oligonucleotide compounds disclosed herein. For example, in one non-limiting embodiment, the methods comprise the step of administering to the animal in need of treatment, a therapeutically effective amount of ANGPTL7 modulator. The ANGPTL7 modulators disclosed herein effectively modulate the activity of the ANGPTL7 or modulate the expression of the ANGPTL7 protein. In some embodiments, the activity or expression of ANGPTL7 in an animal is inhibited or modulated by about 10% as compared to a control. The control may be an oligonucleotide that does not specifically hybridize to ANGPTL7. In some cases, the activity or expression of ANGPTL7 in an animal is inhibited or modulated by about 30%. In some cases, the activity or expression of ANGPTL7 in an animal is inhibited or modulated by 50% or more. Thus, the oligomeric compounds may modulate expression of angiopoietin like 7 (ANGPTL7) mRNA by at least 10%, by at least 50%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100% as compared to a control. The reduction of or modulation in the expression of angiopoietin like 7, (ANGPTL7) may be measured in serum, blood, adipose tissue, liver or any other body fluid, tissue or organ of the animal. In some cases, the cells contained within said fluids, tissues or organs being analyzed contain a nucleic acid molecule encoding ANGPTL7 peptides and or the ANGPTL7 protein itself.

Drug Discovery

The compounds disclosed herein can also be applied in the areas of drug discovery and target validation. The compounds and target segments identified herein may be used in drug discovery efforts to elucidate relationships that exist between angiopoietin like 7 (ANGPTL7) polynucleotides and a disease state, phenotype, or condition. These methods include detecting or modulating ANGPTL7 polynucleotides comprising contacting a sample, tissue, cell, or organism with the compounds disclosed herein, measuring the nucleic acid or protein level of ANGPTL7 polynucleotides and/or a related phenotypic or chemical endpoint at some time after treatment, and optionally comparing the measured value to a non-treated sample or sample treated with a further compound disclosed herein. These methods can also be performed in parallel or in combination with other experiments to determine the function of unknown genes for the process of target validation or to determine the validity of a particular gene product as a target for treatment or prevention of a particular disease, condition, or phenotype.

This disclosure is further illustrated by the following examples, which should not be construed as further limiting. The contents of all references, pending patent applications and published patents, cited throughout this application are hereby expressly incorporated by reference.

EMBODIMENTS

Some embodiments include one or more of the following:

1. An RNA interference (RNAi) agent capable of inhibiting or modulating the expression of angiopoietin like 7 (ANGPTL7), wherein the RNAi agent comprises a double-stranded RNA (dsRNA) comprising a sense strand and an antisense strand, each strand having 14 to 30 nucleotides.

2. The RNAi agent of embodiment 1, wherein the dsRNA has a length of 17-30 nucleotide pairs.

3. The RNAi agent of embodiment 1 or embodiment 2, wherein the sense strand and antisense strand each have 17-30 nucleotides.

4. The RNAi agent of any of embodiments 1-3, wherein the sense strand comprises a sequence at least about 80%, 85%, 90%, 95%, or 100% identical to a sequence selected from SEQ ID NOS: 1-4412.

5. The RNAi agent of any of embodiments 1-4, wherein the antisense strand comprises a sequence at least about 80%, 85%, 90%, 95%, or 100% identical to the reverse complement of the sense strand.

6. The RNAi agent of any of embodiments 1-5, wherein the antisense strand comprises a sequence at least about 80%, 85%, 90%, 95%, or 100% identical to a sequence selected from SEQ ID NOS: 1-4412.

7. The RNAi agent of any of embodiments 1-3, wherein the sequence of the sense strand comprises SEQ ID NO: 11089 and the sequence of the antisense strand comprises SEQ ID NO: 11090.

8. The RNAi agent of any of embodiments 1-7, comprising one or more nucleotide modifications selected from the group consisting of LNA, HNA, CeNA, 2'-methoxyethyl, 2'-O-alkyl, 2'-O-allyl, 2'-C-allyl, 2'-fluoro, and 2'-deoxy.

9. The RNAi agent of any of embodiments 1-8, wherein the nucleotides are modified with either 2'-OCH$_3$ or 2'-F.

10. The RNAi agent of any of embodiments 1-9, further comprising at least one ligand.

11. The RNAi agent of any of embodiments 1-10, comprising one or more nucleotide modifications selected from the group consisting of 2'-O-methyl nucleotide, 2'-deoxyfluoro nucleotide, 2'-O-N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, and 2'-ara-F.

12. The RNAi agent of any of embodiments 1-11, further comprising at least one phosphorothioate or methylphosphonate internucleotide linkage.

13. The RNAi agent of any of embodiments 1-12, wherein the nucleotide at the 1 position of the 5'-end of the antisense strand of the dsRNA is selected from the group consisting of A, dA, dU, U, and dT.

14. The RNAi agent of any of embodiments 1-13, wherein the base pair at the 1 position of the 5'-end of the dsRNA is an AU base pair.

15. An RNA interference (RNAi) agent capable of inhibiting or modulating the expression of ANGPTL7, wherein the RNAi agent comprises a double-stranded RNA(dsRNA) comprising a sense strand and an antisense strand, each of the strands having 14 to 30 nucleotides, wherein the sense strand contains at least two motifs of three identical modifications on three consecutive nucleotides, a first of said sense strand motifs occurring at a cleavage site in the sense strand and a second of said sense strand motifs occurring at a different region of the sense strand that is separated from the first sense strand motif by at least one nucleotide; and wherein the antisense strand contains at least two motifs of three identical modifications on three consecutive nucleotides, a first of said antisense strand motifs occurring at or near the cleavage site in the antisense strand and a second of said antisense strand motifs occurring at a different region of the antisense strand that is separated from the first antisense strand motif by at least one nucleotide; wherein the modification in the first antisense strand motif is different than the modification in the second antisense strand motif.

16. The RNAi agent of embodiment 15, wherein at least one of the nucleotides occurring in the first sense strand motif forms a base pair with one of the nucleotides in the first antisense strand motif.

17. The RNAi agent of embodiment 15 or embodiment 16, wherein the dsRNA has 17-30 nucleotide base pairs.

18. The RNAi agent of embodiment 17, wherein the dsRNA has 17-19 nucleotide base pairs.

19. The RNAi agent of any of embodiments 15-18, wherein each strand has 17-23 nucleotides.

20. The RNAi agent of any of embodiments 15-19, wherein the modifications on the nucleotides of the sense strand and/or antisense strand are selected from the group consisting of LNA, HNA, CeNA, 2'-methoxyethyl, 2'-O-alkyl, 2'-O-allyl, 2'-C-allyl, 2'-fluoro, 2'-deoxy, and combinations thereof.

21. The RNAi agent of any of embodiments 15-20, wherein the modifications on the nucleotides of the sense strand and/or antisense strand are 2'-OCH3 or 2'-F.

22. The RNAi agent of any of embodiments 15-21, further comprising a ligand attached to the 3' end of the sense strand.

23. An RNA interference (RNAi) agent capable of inhibiting or modulating the expression of ANGPTL7, wherein the RNAi agent comprises a double-stranded RNA(dsRNA) comprising a sense strand and an antisense strand, each of the strands having 14 to 30 nucleotides, wherein the sense strand contains at least one motif of three 2'-F modifications on three consecutive nucleotides, one of said motifs occurring at or near the cleavage site in the sense strand; and wherein the antisense strand contains at least one motif of three 2'-0-methyl modifications on three consecutive nucleotides, one of said motifs occurring at or near the cleavage site in the antisense strand.

24. The RNAi agent of embodiment 23, wherein the sense strand comprises a sequence at least about 80%, 85%, 90%, 95%, or 100% identical to a sequence selected from SEQ ID NOS: 1-4412.

25. The RNAi agent of embodiment 23 or embodiment 24, wherein the antisense strand comprises a sequence at least about 80%, 85%, 90%, 95%, or 100% identical to the reverse complement of the sense strand.

26. The RNAi agent of any of embodiments 23-25, wherein the antisense strand comprises a sequence at least about 80%, 85%, 90%, 95%, or 100% identical to a sequence selected from SEQ ID NOS: 1-4412.

27. A method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide 5 to 30 nucleotides in length, wherein said at least one antisense oligonucleotide has at least 50% sequence identity to a reverse complement of a polynucleotide comprising 5 to 30 consecutive nucleotides within nucleotides 1 to 2224 of SEQ ID NO: 11085; thereby modulating a function of and/or the expression of the angiopoietin like 7 (ANGPTL7) polynucleotide in patient cells or tissues, in vivo or in vitro.

28. A method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide 5 to 30 nucleotides in length, wherein said antisense oligonucleotide has at least 50% sequence identity to an antisense oligonucleotide to the angiopoietin like 7 (ANGPTL7) polynucleotide; thereby modulating a function of and/or the expression of the angiopoietin like 7 (ANGPTL7) polynucleotide in patient cells or tissues, in vivo or in vitro.

29. A method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide that targets a region of a natural antisense oligonucleotide of the angiopoietin like 7 (ANGPTL7) polynucleotide; thereby modulating a function of and/or the expression of the angiopoietin like 7 (ANGPTL7) polynucleotide in patient cells or tissues, in vivo or in vitro.

30. A method of modulating a function of and/or the expression of an angiopoietin like 7 (ANGPTL7) polynucleotide in patient cells or tissues, in vivo or in vitro, the method comprising: contacting said cells or tissues with at least one antisense oligonucleotide 5 to 30 nucleotides in length; thereby modulating a function of and/or the expression of the ANGPTL7 polynucleotide in patient cells or tissues, in vivo or in vitro.

31. The method of any one of embodiments 27-29, wherein the at least one antisense oligonucleotide comprises SEQ ID NO: 11087.

32. The method of embodiment 30, wherein the at least one antisense oligonucleotide comprises a sequence selected from SEQ ID NOS: 4413-11084.

33. The method of any one of embodiments 27-29, wherein the at least one antisense oligonucleotide comprises a sequence at least about 80%, 85%, 90%, 95% identical to SEQ ID SEQ ID NOS: 4413-11084.

34. The method of any of embodiments 27-33, wherein a function of and/or the expression of the angiopoietin like 7 (ANGPTL7) is increased in vivo or in vitro with respect to a control oligonucleotide that does not target or specifically hybridize to ANGPTL7.

35. The method of any of embodiments 27-33, wherein a function of and/or the expression of the angiopoietin like 7 (ANGPTL7) is decreased in vivo or in vitro with respect to a control oligonucleotide that does not target or specifically hybridize to ANGPTL7.

36. The method of any of embodiments 27-35, wherein the at least one antisense oligonucleotide targets a natural antisense sequence of an angiopoietin like 7 (ANGPTL7) polynucleotide.

37. The method of any of embodiments 27-36, wherein the at least one antisense oligonucleotide targets a nucleic acid sequence comprising coding and/or non-coding nucleic acid sequences of an angiopoietin like 7 (ANGPTL7) polynucleotide.

38. The method of any of embodiments 27-37, wherein the at least one antisense oligonucleotide targets overlapping and/or non-overlapping sequences of an angiopoietin like 7 (ANGPTL7) polynucleotide.

39. The method of any of embodiments 27-38, wherein the at least one antisense oligonucleotide comprises one or more modifications.

40. The method of embodiment 39, wherein the one or more modifications is selected from: at least one modified sugar moiety, at least one modified internucleoside linkage, at least one modified nucleotide, and combinations thereof.

41. The method of embodiment 39, wherein the one or more modifications comprise at least one modified sugar moiety selected from: a 2'-O-methoxy ethyl modified sugar moiety, a 2'-methoxy modified sugar moiety, a 2'-O-alkyl modified sugar moiety, a bicyclic sugar moiety, and combinations thereof.

42. The method of embodiment 39, wherein the one or more modifications comprise at least one modified internucleoside linkage selected from: a phosphorothioate, 2'-Omethoxyethyl (MOE), 2'-fluoro, alkylphosphonate, phosphorodithioate, alkylphosphonothioate, phosphoramidate, carbamate, carbonate, phosphate triester, acetamidate, carboxymethyl ester, and combinations thereof.

43. The method of embodiment 39, wherein the one or more modifications comprise at least one modified nucleotide selected from: a peptide nucleic acid (PNA), a locked nucleic acid (LNA), an arabino-nucleic acid (FANA), an analogue, a derivative, and combinations thereof.

44. A method of modulating a function of and/or the expression of an angiopoietin like 7 (ANGPTL7) gene in mammalian cells or tissues, in vivo or in vitro, the method comprising: contacting said cells or tissues with at least one short interfering RNA (siRNA) oligonucleotide 5 to 30 nucleotides in length, said at least one siRNA oligonucleotide being specific for an antisense polynucleotide of an angiopoietin like 7 (ANGPTL7) polynucleotide, wherein said at least one siRNA oligonucleotide has at least 50% sequence identity to a complementary sequence of at least about five consecutive nucleic acids of the antisense and/or sense nucleic acid molecule of the angiopoietin like 7 (ANGPTL7) polynucleotide; thereby modulating a function of and or the expression of angiopoietin like 7, (ANGPTL7) in mammalian cells or tissues in vivo or in vitro.

45. The method of embodiment 44, wherein said oligonucleotide has at least 80% sequence identity to a sequence of at least about five consecutive nucleic acids that is complementary to the antisense and/or sense nucleic acid molecule of the angiopoietin like 7 (ANGPTL7) polynucleotide.

46. The method of embodiment 44 or embodiment 45, wherein the at least one siRNA oligonucleotide comprises a sequence selected from SEQ ID NOS: 1-4412.

47. The method of embodiment 44 or embodiment 45, wherein the at least one siRNA oligonucleotide comprises a sequence at least about 80%, 85%, 90%, 95%, or 100% identical to a sequence selected from SEQ ID NOS: 1-4412.

48. A method of modulating a function of and/or the expression of angiopoietin like 7, (ANGPTL7) in mammalian cells or tissues, in vivo or in vitro, the method comprising: contacting said cells or tissues with at least one antisense oligonucleotide of about 5 to 30 nucleotides in length, the antisense oligonucleotide specific for noncoding and/or coding sequences of a sense and/or natural antisense strand of an angiopoietin like 7 (ANGPTL7) polynucleotide, wherein said at least one antisense oligonucleotide has at least 50% sequence identity to at least one nucleic acid sequence set forth as 1 to 2224 of SEQ ID NO: 11085 or its complement; thereby modulating the function and/or expression of the angiopoietin like 7 (AGNPTL7) in mammalian cells or tissues, in vivo or in vitro.

49. The method of embodiment 48, wherein the at least one antisense oligonucleotide comprises a sequence selected from SEQ ID NOS: 4413-11084.

50. The method of embodiment 48, wherein the at least one antisense oligonucleotide comprises a sequence at least about 80%, 85%, 90%, 95% identical to SEQ ID NOS: 4413-11084.

51. A synthetic, modified oligonucleotide comprising at least one modification wherein the at least one modification is selected from: at least one modified sugar moiety; at least one modified intenucleotide linkage; at least one modified nucleotide, and combinations thereof; wherein said oligonucleotide is an antisense compound which hybridizes to and modulates the function and/or expression of an angiopoietin like 7 (ANGPTL7) polynucleotide in vivo or in vitro as compared to a control oligonucleotide that does not specifically hybridize to the ANGPTL7 polynucleotide.

52. The oligonucleotide of embodiment 51, wherein the at least one modification comprises an internucleotide linkage selected from the group consisting of: phosphorothioate, alkylphosphonate, phosphorodithioate, alkylphosphonothioate, phosphoramidate, carbamate, carbonate, phosphate triester, acetamidate, carboxymethyl ester, and combinations thereof.

53. The oligonucleotide of embodiment 52, wherein said oligonucleotide comprises at least one phosphorothioate internucleotide linkage.

54. The oligonucleotide of embodiment 52, wherein said oligonucleotide comprises a backbone of phosphorothioate internucleotide linkages.

55. The oligonucleotide of embodiment 52, wherein the oligonucleotide comprises at least one modified nucleotide, said modified nucleotide selected from: a peptide nucleic acid, a locked nucleic acid (LNA), and an analogue, derivative, and a combination thereof.

56. The oligonucleotide of embodiment 51, wherein the oligonucleotide comprises a plurality of modifications, wherein said modifications comprise modified nucleotides selected from: phosphorothioate, alkylphosphonate, phosphorodithioate, alkylphosphonothioate, phosphoramidate, carbamate, carbonate, phosphate triester, acetamidate, carboxymethyl ester, and a combination thereof.

57. The oligonucleotide of embodiment 51, wherein the oligonucleotide comprises a plurality of modifications, wherein said modifications comprise modified nucleotides selected from: peptide nucleic acids, locked nucleic acids (LNA), and analogues, derivatives, and a combination thereof.

58. The oligonucleotide of embodiment 51, wherein the oligonucleotide comprises at least one modified sugar moiety selected from: a 2'-O-methoxyethyl modified sugar moiety, a 2'-methoxy modified sugar moiety, a 2-O-alkyl modified sugar moiety, a bicyclic sugar moiety, and a combination thereof.

59. The oligonucleotide of embodiment 51, wherein the oligonucleotide comprises a plurality of modifications, wherein said modifications comprise modified sugar moieties selected from: a 2'-0-methoxy ethyl modified sugar moiety, a 2-methoxy modified sugar moiety, a 2'-0-alkyl modified sugar moiety, a bicyclic sugar moiety, and a combination thereof.

60. The oligonucleotide of embodiment 51, wherein the oligonucleotide is of at least about 5 to 30 nucleotides in length and hybridizes to an antisense and/or sense strand of an angiopoietin like 7 (ANGPTL7) polynucleotide, wherein said oligonucleotide has at least about 20% sequence identity to a complementary sequence of at least about five consecutive nucleic acids of the antisense and/or sense coding and/or noncoding nucleic acid sequences of the angiopoietin like 7 (ANGPTL7) polynucleotide.

61. The oligonucleotide of embodiment 51, wherein the oligonucleotide has at least about 80% sequence identity to a complementary sequence of at least about five consecutive nucleic acids of the antisense and or sense coding and/or noncoding nucleic acid sequence of the angiopoietin like 7 (ANGPTL7) polynucleotide.

62. The oligonucleotide of embodiment 51, wherein said oligonucleotide hybridizes to and modulates expression and/ or function of at least one angiopoietin like 7 (ANGPTL7) polynucleotide, in vivo or in vitro, as compared to the control oligonucleotide.

63. The oligonucleotide of embodiment 51, wherein the oligonucleotide comprises the sequence set forth as SEQ ID NO: 11087.

64. The oligonucleotide of any one of embodiments 51-63, wherein the at least one antisense oligonucleotide comprises SEQ ID NOS: 4413-11084.

65. The oligonucleotide of any one of embodiments 51-63, wherein the at least one antisense oligonucleotide comprises a sequence at least about 80%, 85%, 90%, or 95% identical to SEQ ID NOS: 4413-11084.

66. A composition comprising one or more oligonucleotides specific for one or more angiopoietin like 7 (ANGPTL7) polynucleotides, said one or more oligonucleotides comprising an antisense sequence, complementary sequence, allele, homolog, isoform, variant, derivative, mutant, or fragment of the ANGPTL7 polynucleotide, or a combination thereof.

67. The composition of embodiment 66 wherein the one or more oligonucleotides have at least about 40% sequence identity as compared to the nucleotide sequence set forth as SEQ ID NO: 11087.

68. The composition of embodiment 66 or embodiment 67, wherein the oligonucleotide comprises the nucleotide sequence set forth as SEQ ID NO: 11087.

69. The composition of embodiment 66, wherein the one or more oligonucleotides comprises a sequence selected from SEQ ID NOS: 1-4412.

70. The composition of embodiment 66, wherein the one or more oligonucleotides comprises a sequence at least about 80%, 85%, 90%, 95%, or 100% identical to a sequence selected from SEQ ID NOS: 1-4412.

71. The composition of any of embodiments 66-70, wherein the one or more oligonucleotides comprises one or more modifications or substitutions.

72. The composition of embodiment 71, wherein the one or more modifications are selected from: phosphorothioate, methylphosphonate, peptide nucleic acid, locked nucleic acid (LNA) molecules, and combinations thereof.

73. A method of preventing or treating a disease associated with at least one angiopoietin like 7 (ANGPTL7) polynucleotide and/or at least one encoded product thereof, the method comprising: administering to a subject in need thereof a therapeutically effective dose of at least one antisense oligonucleotide that binds to a natural antisense sequence of said at least one angiopoietin like 7 (ANGPTL7) polynucleotide and modulates expression of said at least one angiopoietin like 7 (ANGPTL7) polynucleotide; thereby preventing or treating the disease associated with the at least one angiopoietin like 7 (ANGPTL7) polynucleotide and or at least one encoded product thereof.

74. A method of preventing or treating a disease associated with at least one angiopoietin like 7 (ANGPTL7) polynucleotide and/or at least one encoded product thereof, the method comprising: administering to a subject in need thereof a therapeutically effective dose of at least one antisense oligonucleotide that binds to a natural sense sequence of said at least one angiopoietin like 7 (ANGPTL7) polynucleotide and modulates expression of said at least one angiopoietin like 7 (ANGPTL7) polynucleotide; thereby preventing or treating the disease associated with the at least one angiopoietin like 7 (ANGPTL7) polynucleotide and or at least one encoded product thereof.

75. The method of embodiment 73 or embodiment 74, wherein a disease associated with the at least one angiopoietin like 7 (ANGPTL7) polynucleotide is selected from: a disease or disorder associated with abnormal function and/or expression of ANGPTL7, a disease or disorder associated with optic nerve damage, a disease or disorder associated with intraocular pressure, a degenerative retinal disease or disorder, an inflammatory eye disease or disorder, an allergic eye disease or disorder, a disease or disorder associated with degeneration or inflammation of the joints, a disease or disorder associated with abnormal lipid metabolism, cancer, Alzheimer's disease, dementia, stroke and brain ischemia.

76. The method of embodiment 75, wherein the disease or disorder associated with optic nerve damage comprises primary open-angle glaucoma, primary angle-closure glaucoma, normal-tension glaucoma, pigmentary glaucoma, exfoliation glaucoma, juvenile glaucoma, congenital glaucoma, inflammatory glaucoma, phacogenic glaucoma, glaucoma secondary to intraocular hemorrhage, traumatic glaucoma, neovascular glaucoma, drug-induced glaucoma, toxic glaucoma, absolute glaucoma, ocular hypertension, or a combination thereof.

77. The method of embodiment 75, wherein the disease or disorder associated with degeneration or inflammation of the joints comprises osteoarthritis, osteoarthrosis or a combination thereof.

78. The method of embodiment 75, wherein the cancer is selected from lung cancer, epidermoid carcinoma, breast cancer, or a combination thereof.

79. A method of identifying and selecting at least one oligonucleotide for in vivo administration comprising: identifying at least one oligonucleotide comprising at least five consecutive nucleotides which are complementary to ANGPTL7 or to a polynucleotide that is antisense to ANGPTL7; measuring the thermal melting point of a hybrid of an antisense oligonucleotide and the ANGPTL7 or the polynucleotide that is antisense to the ANGPTL7 under stringent hybridization conditions; and selecting at least one oligonucleotide for in vivo administration based on the information obtained.

80. A method of treating a disease or condition mediated by ANGPTL7, the method comprising administering to a subject in need thereof an oligonucleotide comprising a sequence at least about 80%, 85%, 90%, 95%, or 100% identical to a sequence selected from SEQ ID NOS: 1-4412.

81. The method of embodiment 80, wherein the oligonucleotide comprises a sequence selected from SEQ ID NOS: 1-4412.

82. The method of embodiment 80 or embodiment 81, wherein the target is ANGPTL7.

83. The method of any of embodiments 80-82, wherein the disease or condition comprises glaucoma (including, primary open-angle glaucoma, primary angle-closure glaucoma, normal-tension glaucoma, pigmentary glaucoma, exfoliation glaucoma, juvenile glaucoma, congenital glaucoma, inflammatory glaucoma, phacogenic glaucoma, glaucoma secondary to intraocular hemorrhage, traumatic glaucoma, neovascular glaucoma, drug-induced glaucoma, toxic glaucoma and absolute glaucoma), ocular hypertension, optic neuropathy or a combination thereof.

84. The method of any of embodiments 80-83, wherein the oligonucleotide comprises dsRNA 85. The method of embodiment 84, wherein the oligonucleotide comprises a sequence at least about 80%, 85%, 90%, 95%, or 100% identical to a sequence selected from SEQ ID NOS: 1-4412.

86. The method of any of embodiments 80-83, wherein the oligonucleotide comprises a sequence at least about 80%, 85%, 90%, 95%, or 100% identical to SEQ ID NOS: 4413-11084.

87. A method of treating one or more disorders of the eye in a subject in need thereof comprising editing an ANGPTL7 gene in the subject wherein the one or more disorders of the eye comprises glaucoma or ocular hypertension.

88. The method of embodiment 87, wherein the editing of the ANGPTL7 gene comprises administering CRISPR/cas9 to the subject.

89. The method of embodiment 88, wherein the CRISPR/cas9 targets the ANGPTL7 gene.

90. The method of embodiment 88, wherein the CRISPR/cas9 edits the ANGPTL7 gene to a loss of function mutation.

91. The method of embodiment 90, wherein the loss of function mutation comprises a premature stop mutation.

92. The method of embodiment 91, wherein the premature stop mutation occurs at amino acid position 177 according to the human protein sequence numbering.

93. The method of embodiment 88, wherein the CRISPR/cas9 edits the ANGPTL7 gene to a missense mutation.

94. The method of embodiment 93, wherein the missense mutation comprises a glutamine to histidine mutation.

95. The method of embodiment 94, wherein the glutamine to histidine mutation occurs at amino acid position 175 according to the human protein sequence numbering.

96. The method of embodiment 88, wherein the CRISPR/cas9 is delivered systemically to the subject.

97. The method of embodiment 88, wherein the CRISPR/cas9 is delivered locally to the subject.

98. The method of embodiment 97, wherein the CRISPR/cas9 is delivered locally to the eye of the subject.

99. The method of embodiment 88, wherein the editing of the ANGPTL7 gene is efficacious in treating the one or more disorders of the eye.

100. The method of embodiment 99, wherein the one or more disorders of the eye is glaucoma.

101. The method of embodiment 99, wherein the subject has ocular hypertension.

102. The method of embodiment 101, wherein imaging from the subject ocular hypertension demonstrates optic nerve damage.

103. The method of embodiment 87, wherein the subject has received a first line treatment comprised of topical ocular prostaglandin analogues, beta-adrenergic blockers, alpha-adrenergic agonists, and carbonic anhydrase inhibitors for the one or more disorders of the eye.

104. The method of embodiment 87, wherein the editing of the ANGPTL7 gene causes a reduction in or modulation of the production of the gene product of ANGPTL7 in the subject.

105. The method of embodiment 87, wherein the editing of the ANGPTL7 gene causes a reduction in the subject of intraocular pressure.

106. A composition comprising CRISPR/cas9 that targets ANGPTL7 that is efficacious in treating glaucoma or ocular hypertension.

107. The composition of embodiment 106, wherein the CRISPR/cas9 edits the ANGPTL7 gene to a loss of function mutation.

108. The composition of embodiment 107, wherein the loss of function mutation comprises a premature stop mutation.

109. The composition of embodiment 108, wherein the premature stop mutation occurs at amino acid position 177 according to the human protein sequence numbering.

110. The composition of embodiment 106, wherein the CRISPR/cas9 edits the ANGPTL7 gene to a missense mutation.

111. The composition of embodiment 110, wherein the missense mutation comprises a glutamine to histidine mutation.

112. The composition of embodiment 111, wherein the glutamine to histidine mutation occurs at amino acid position 175 according to the human protein sequence numbering.

113. A pharmaceutical composition comprising an siRNA molecule comprising a sense strand and an antisense strand, which targets SEQ ID NO. 11086 and when introduced to an eye of a patient in an effective amount reduces intraocular pressure of the eye; and a pharmaceutically acceptable carrier.

114. The pharmaceutical composition of embodiment 113, wherein the siRNA molecule reduces intraocular pressure by at least 5%, at least 10%, at least 15%, at least 20%, at least 25%, at least 30% relative to a pre-treatment value of intraocular pressure in the eye of the patient.

115. The pharmaceutical composition of embodiment 113, wherein the pharmaceutical composition is formulated for topical administration to the eye.

116. The pharmaceutical composition of any of embodiments 113-115, wherein the siRNA has a length of 17-30 nucleotide pairs.

117. The pharmaceutical composition of any of embodiments 113-115, wherein the sense strand and antisense strand each have 17-30 nucleotides.

118. The pharmaceutical composition of any of embodiments 113-115, wherein the sense strand and antisense strand each have 21 nucleotides.

119. The pharmaceutical composition of any of embodiments 113-117, wherein the sense strand comprises a sequence at least about 80%, 85%, 90%, 95%, or 100% identical to a sequence selected from SEQ ID NOS: 1-4412.

120. The pharmaceutical composition of any of embodiments 113-118, wherein the antisense strand comprises a sequence at least about 80%, 85%, 90%, 95%, or 100% identical to the reverse complement of the sense strand.

121. The pharmaceutical composition of any of embodiments 113-119, wherein the antisense strand comprises a sequence at least about 80%, 85%, 90%, 95%, or 100% identical to a sequence selected from SEQ ID NOS: 1-4412.

122. The pharmaceutical composition of any of embodiments 113-116, wherein the sequence of the sense strand comprises SEQ ID NO: 11089 and the sequence of the antisense strand comprises SEQ ID NO: 11090.

123. The pharmaceutical composition of any of embodiments 113-121, comprising a modified internucleoside linkage.

124. The pharmaceutical composition of embodiment 123, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

125. The pharmaceutical composition of embodiment 124, wherein the modified internucleoside linkage comprises one or more phosphorothioate linkages.

126. The pharmaceutical composition of embodiment 125, wherein the one or more phosphorothioate linkages is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 phosphorothioate linkages.

127. The pharmaceutical composition of embodiment 124 or embodiment 125, wherein the sense strand of the siRNA comprises one or more phosphorothioate linkages.

128. The pharmaceutical composition of embodiment 127, wherein the one or more phosphorothioate linkages of the sense strand is about 1, 2, 3, 4, 5, 6, 7, 8, 9, 10, 11, 12, 13, 14, 15, 16, 17, 18, 19, 20, or 21 phosphorothioate linkages.

129. The pharmaceutical composition of embodiment 128, wherein the one or more phosphorothioate linkages of the sense strand is about 1, 2, 3, 4, or 5 phosphorothioate linkages.

130. The pharmaceutical composition of embodiment 129, wherein the one or more phosphorothioate linkages of the sense strand is about 4 phosphorothioate linkages.

131. The pharmaceutical composition of any one of embodiments 127-130, wherein the sense strand comprises a phosphorothioate linkage between the first nucleoside and the second nucleoside of the sense strand, in a 5' to 3' direction.

132. The pharmaceutical composition of any one of embodiments 127-131, wherein the sense strand comprises a phosphorothioate linkage between the second nucleoside and the third nucleoside of the sense strand, in a 5' to 3' direction.

133. The pharmaceutical composition of any one of embodiments 127-132, wherein the sense strand comprises a phosphorothioate linkage between the nineteenth nucleoside and the twentieth nucleoside of the sense strand, in a 5' to 3' direction.

134. The pharmaceutical composition of any one of embodiments 127-133, wherein the sense strand comprises a phosphorothioate linkage between the twentieth nucleoside and the twenty-first nucleoside of the sense strand, in a 5' to 3' direction.

135. The pharmaceutical composition of any one of embodiments 124-134, wherein the antisense strand of the siRNA comprises one or more phosphorothioate linkages.

136. The pharmaceutical composition of embodiment 135, wherein the one or more phosphorothioate linkages of the antisense strand is about 1, 2, 3, 4, 5, 6, 7, 8, 9, 10, 11, 12, 13, 14, 15, 16, 17, 18, 19, 20, or 21 phosphorothioate linkages.

137. The pharmaceutical composition of embodiment 136, wherein the one or more phosphorothioate linkages of the antisense strand is about 1, 2, 3, 4, or 5 phosphorothioate linkages.

138. The pharmaceutical composition of embodiment 137, wherein the one or more phosphorothioate linkages of the antisense strand is about 4 phosphorothioate linkages.

139. The pharmaceutical composition of any one of embodiments 135-138, wherein the antisense strand comprises a phosphorothioate linkage between the first nucleoside and the second nucleoside of the antisense strand, in a 5' to 3' direction.

140. The pharmaceutical composition of any one of embodiments 135-139, wherein the antisense strand comprises a phosphorothioate linkage between the second nucleoside and the third nucleoside of the antisense strand, in a 5' to 3' direction.

141. The pharmaceutical composition of any one of embodiments 135-140, wherein the antisense strand comprises a phosphorothioate linkage between the nineteenth nucleoside and the twentieth nucleoside of the sense strand, in a 5' to 3' direction.

142. The pharmaceutical composition of any one of embodiments 135-141, wherein the antisense strand comprises a phosphorothioate linkage between the twentieth nucleoside and the twenty-first nucleoside of the sense strand, in a 5' to 3' direction.

143. The pharmaceutical composition of any one of embodiments 113-142, comprising a modified nucleoside.

144. The pharmaceutical composition of embodiment 143, wherein the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

145. The pharmaceutical composition of embodiment 144, wherein the modified nucleoside comprises a of 2'-O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl (2'-O-AP) nucleoside, or 2'-ara-F, or a combination thereof.

146. The pharmaceutical composition of embodiment 144, wherein the modified nucleoside comprises one or more 2'fluoro modified nucleosides.

147. The pharmaceutical composition of embodiment 146, wherein the one or more 2' fluoro modified nucleosides is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 2' fluoro modified nucleosides.

148. The pharmaceutical composition of embodiment 145 or embodiment 146, wherein the sense strand of the siRNA comprises one or more 2' fluoro modified nucleosides.

149. The pharmaceutical composition of embodiment 148, wherein the one or more 2' fluoro modified nucleosides of the sense strand is about 1, 2, 3, 4, 5, 6, 7, 8, 9, 10, 11, 12, 13, 14, 15, 16, 17, 18, 19, 20, or 21 2' fluoro modified nucleosides.

150. The pharmaceutical composition of embodiment 149, wherein the one or more 2' fluoro modified nucleosides of the sense strand is about eleven 2' fluoro modified nucleosides.

151. The pharmaceutical composition of embodiment 149, wherein the one or more 2' fluoro modified nucleosides of the sense strand is about four 2' fluoro modified nucleosides.

152. The pharmaceutical composition of embodiment 149, wherein the one or more 2' fluoro modified nucleosides of the sense strand is about three 2' fluoro modified nucleosides.

153. The pharmaceutical composition of any one of embodiments 148-152, wherein the first nucleoside of the sense strand comprises the 2' fluoro modified nucleoside, in a 5' to 3' direction.

154. The pharmaceutical composition of any one of embodiments 148-153, wherein the third nucleoside of the sense strand comprises the 2' fluoro modified nucleoside, in a 5' to 3' direction.

155. The pharmaceutical composition of any one of embodiments 148-154, wherein the fifth nucleoside of the sense strand comprises the 2' fluoro modified nucleoside, in a 5' to 3' direction.

156. The pharmaceutical composition of any one of embodiments 148-155, wherein the seventh nucleoside of the sense strand comprises the 2' fluoro modified nucleoside, in a 5' to 3' direction.

157. The pharmaceutical composition of any one of embodiments 148-156, wherein the eighth nucleoside of the sense strand comprises the 2' fluoro modified nucleoside, in a 5' to 3' direction.

158. The pharmaceutical composition of any one of embodiments 148-157, wherein the ninth nucleoside of the sense strand comprises the 2' fluoro modified nucleoside, in a 5' to 3' direction.

159. The pharmaceutical composition of any one of embodiments 148-158, wherein the eleventh nucleoside of the sense strand comprises the 2' fluoro modified nucleoside, in a 5' to 3' direction.

160. The pharmaceutical composition of any one of embodiments 148-159, wherein the thirteenth nucleoside of the sense strand comprises the 2' fluoro modified nucleoside, in a 5' to 3' direction.

161. The pharmaceutical composition of any one of embodiments 148-160, wherein the fifteenth nucleoside of the sense strand comprises the 2' fluoro modified nucleoside, in a 5' to 3' direction.

162. The pharmaceutical composition of any one of embodiments 148-161, wherein the seventeenth nucleoside of the sense strand comprises the 2' fluoro modified nucleoside, in a 5' to 3' direction.

163. The pharmaceutical composition of any one of embodiments 148-162, wherein the nineteenth nucleoside of the sense strand comprises the 2' fluoro modified nucleoside, in a 5' to 3' direction.

164. The pharmaceutical composition of any one of embodiments 148-163, wherein the fifth, seventh, and ninth nucleosides of the sense strand comprises the 2' fluoro modified nucleoside, in a 5' to 3' direction.

165. The pharmaceutical composition of any one of embodiments 148-164, comprising the pattern fN-Z1-fN-Z2-fN, wherein fN comprises the 2' fluoro modified nucleoside and Z1 and Z2 are independently a 2' O-methyl modified nucleoside or a 2' fluoro modified nucleoside.

166. The pharmaceutical composition of embodiment 165, wherein the fN-Z1-fN-Z2-fN corresponds to nucleosides five to nine of the sense strand, in a 5' to 3' direction.

167. The pharmaceutical composition of any one of embodiments 148-166, wherein the sense strand comprises at least two contiguous 2' fluoro modified nucleosides.

168. The pharmaceutical composition of embodiment 167, wherein the at least two contiguous 2' fluoro modified nucleosides is two contiguous 2' fluoro modified nucleosides.

169. The pharmaceutical composition of embodiment 168, wherein the at least two contiguous 2' fluoro modified nucleosides is three contiguous 2' fluoro modified nucleosides.

170. The pharmaceutical composition of any one of embodiments 145-169, wherein the antisense strand of the siRNA comprises one or more 2' fluoro modified nucleosides.

171. The pharmaceutical composition of embodiment 170, wherein the one or more 2' fluoro modified nucleosides of the antisense strand is about 1, 2, 3, 4, 5, 6, 7, 8, 9, 10, 11, 12, 13, 14, 15, 16, 17, 18, 19, 20, or 21 2' fluoro modified nucleosides.

172. The pharmaceutical composition of embodiment 171, wherein the one or more 2' fluoro modified nucleosides of the antisense strand is about eight 2' fluoro modified nucleosides.

173. The pharmaceutical composition of embodiment 171, wherein the one or more 2' fluoro modified nucleosides of the antisense strand is about six 2' fluoro modified nucleosides.

174. The pharmaceutical composition of embodiment 171, wherein the one or more 2' fluoro modified nucleosides of the antisense strand is about five 2' fluoro modified nucleosides.

175. The pharmaceutical composition of embodiment 171, wherein the one or more 2' fluoro modified nucleosides of the antisense strand is about four 2' fluoro modified nucleosides.

176. The pharmaceutical composition of any one of embodiments 170-175, wherein the second nucleoside of the antisense strand comprises the 2' fluoro modified nucleoside, in a 5' to 3' direction.

177. The pharmaceutical composition of any one of embodiments 170-176, wherein the fourth nucleoside of the antisense strand comprises the 2' fluoro modified nucleoside, in a 5' to 3' direction.

178. The pharmaceutical composition of any one of embodiments 170-177, wherein the sixth nucleoside of the antisense strand comprises the 2' fluoro modified nucleoside, in a 5' to 3' direction.

179. The pharmaceutical composition of any one of embodiments 170-178, wherein the eighth nucleoside of the antisense strand comprises the 2' fluoro modified nucleoside, in a 5' to 3' direction.

180. The pharmaceutical composition of any one of embodiments 170-179, wherein the ninth nucleoside of the antisense strand comprises the 2' fluoro modified nucleoside, in a 5' to 3' direction.

181. The pharmaceutical composition of any one of embodiments 170-180, wherein the tenth nucleoside of the antisense strand comprises the 2' fluoro modified nucleoside, in a 5' to 3' direction.

182. The pharmaceutical composition of any one of embodiments 170-181, wherein the fourteenth nucleoside of the antisense strand comprises the 2' fluoro modified nucleoside, in a 5' to 3' direction.

183. The pharmaceutical composition of any one of embodiments 170-182, wherein the sixteenth nucleoside of the antisense strand comprises the 2' fluoro modified nucleoside, in a 5' to 3' direction.

184. The pharmaceutical composition of any one of embodiments 170-183, wherein the eighteenth nucleoside of the antisense strand comprises the 2' fluoro modified nucleoside, in a 5' to 3' direction.

185. The pharmaceutical composition of any one of embodiments 170-184, wherein the second and fourteenth nucleosides of the antisense strand comprises the 2' fluoro modified nucleoside, in a 5' to 3' direction.

186. The pharmaceutical composition of any one of embodiments 170-185, wherein the second, sixth, fourteenth, and sixteenth nucleosides of the antisense strand comprises the 2' fluoro modified nucleoside, in a 5' to 3' direction.

187. The pharmaceutical composition of any one of embodiments 170-186, comprising the pattern Z3-fN-Z4-fN, wherein fN comprises the 2' fluoro modified nucleoside and Z3 and Z4 are independently a 2' O-methyl modified nucleoside or a 2' fluoro modified nucleoside.

188. The pharmaceutical composition of embodiment 187, wherein the Z3-fN-Z4-fN corresponds to nucleosides thirteen to sixteen of the antisense strand, in a 5' to 3' direction.

189. The pharmaceutical composition of any one of embodiments 143-188, wherein the modified nucleoside comprises a 2' O-alkyl modified nucleoside.

190. The pharmaceutical composition of embodiment 189, wherein the 2'-0-alkyl modified nucleoside comprises one or more 2' O-methyl modified nucleosides.

191. The pharmaceutical composition of embodiment 190, wherein the one or more 2' O-methyl modified nucleosides is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 2' O-methyl modified nucleosides.

192. The pharmaceutical composition of any one of embodiments 189-191, wherein the sense strand of the siRNA comprises one or more 2' O-methyl modified nucleosides.

193. The pharmaceutical composition of embodiment 192, wherein the one or more 2' O-methyl modified nucleosides of the sense strand is about 1, 2, 3, 4, 5, 6, 7, 8, 9, 10, 11, 12, 13, 14, 15, 16, 17, 18, 19, 20, or 21 2' O-methyl modified nucleosides.

194. The pharmaceutical composition of embodiment 193, wherein the one or more 2' O-methyl modified nucleosides of the sense strand is about ten 2' O-methyl modified nucleosides.

195. The pharmaceutical composition of embodiment 193, wherein the one or more 2' O-methyl modified nucleosides of the sense strand is about seventeen 2' O-methyl modified nucleosides.

196. The pharmaceutical composition of embodiment 193, wherein the one or more 2' O-methyl modified nucleosides of the sense strand is about eighteen 2' O-methyl modified nucleosides.

197. The pharmaceutical composition of any one of embodiments 192-196, wherein the first nucleoside of the sense strand comprises the 2' O-methyl modified nucleoside, in a 5' to 3' direction.

198. The pharmaceutical composition of any one of embodiments 192-197, wherein the second nucleoside of the sense strand comprises the 2' O-methyl modified nucleoside, in a 5' to 3' direction.

199. The pharmaceutical composition of any one of embodiments 192-198, wherein the third nucleoside of the sense strand comprises the 2' O-methyl modified nucleoside, in a 5' to 3' direction.

200. The pharmaceutical composition of any one of embodiments 192-199, wherein the fourth nucleoside of the sense strand comprises the 2' O-methyl modified nucleoside, in a 5' to 3' direction.

201. The pharmaceutical composition of any one of embodiments 192-200, wherein the sixth nucleoside of the sense strand comprises the 2' O-methyl modified nucleoside, in a 5' to 3' direction.

202. The pharmaceutical composition of any one of embodiments 192-201, wherein the eighth nucleoside of the sense strand comprises the 2' O-methyl modified nucleoside, in a 5' to 3' direction.

203. The pharmaceutical composition of any one of embodiments 192-202, wherein the tenth nucleoside of the sense strand comprises the 2' O-methyl modified nucleoside, in a 5' to 3' direction.

204. The pharmaceutical composition of any one of embodiments 192-203, wherein the eleventh nucleoside of the sense strand comprises the 2' O-methyl modified nucleoside, in a 5' to 3' direction.

205. The pharmaceutical composition of any one of embodiments 192-204, wherein the twelfth nucleoside of the sense strand comprises the 2' O-methyl modified nucleoside, in a 5' to 3' direction.

206. The pharmaceutical composition of any one of embodiments 192-205, wherein the thirteenth nucleoside of the sense strand comprises the 2' O-methyl modified nucleoside, in a 5' to 3' direction.

207. The pharmaceutical composition of any one of embodiments 192-206, wherein the fourteenth nucleoside of the sense strand comprises the 2' O-methyl modified nucleoside, in a 5' to 3' direction.

208. The pharmaceutical composition of any one of embodiments 192-207, wherein the fifteenth nucleoside of the sense strand comprises the 2' O-methyl modified nucleoside, in a 5' to 3' direction.

209. The pharmaceutical composition of any one of embodiments 192-208, wherein the sixteenth nucleoside of the sense strand comprises the 2' O-methyl modified nucleoside, in a 5' to 3' direction.

210. The pharmaceutical composition of any one of embodiments 192-209, wherein the seventeenth nucleoside of the sense strand comprises the 2' O-methyl modified nucleoside, in a 5' to 3' direction.

211. The pharmaceutical composition of any one of embodiments 192-210, wherein the eighteenth nucleoside of the sense strand comprises the 2' O-methyl modified nucleoside, in a 5' to 3' direction.

212. The pharmaceutical composition of any one of embodiments 192-211, wherein the nineteenth nucleoside of the sense strand comprises the 2' O-methyl modified nucleoside, in a 5' to 3' direction.

213. The pharmaceutical composition of any one of embodiments 192-212, wherein the twentieth nucleoside of the sense strand comprises the 2' O-methyl modified nucleoside, in a 5' to 3' direction.

214. The pharmaceutical composition of any one of embodiments 192-213, wherein the twenty-first nucleoside of the sense strand comprises the 2' O-methyl modified nucleoside, in a 5' to 3' direction.

215. The pharmaceutical composition of any one of embodiments 192-214, wherein the second, fourth, sixth, tenth, twelfth, fourteenth, and sixteenth, eighteenth, twentieth, and twenty-first nucleosides of the sense strand comprises the 2' O-methyl modified nucleoside, in a 5' to 3' direction.

216. The pharmaceutical composition of any one of embodiments 192-215, comprising the pattern mN-Z5-mN-Z6, wherein mN comprises the 2' O-methyl modified nucleoside and Z5 and Z6 are independently a 2' O-methyl modified nucleoside or a 2' fluoro modified nucleoside.

217. The pharmaceutical composition of embodiment 216, wherein the mN-Z5-mN-Z6-mN corresponds to nucleosides four to seven of the sense strand, in a 5' to 3' direction.

218. The pharmaceutical composition of embodiment 216 or embodiment 217, wherein Z5 is the 2' fluoro modified nucleoside.

219. The pharmaceutical composition of embodiment 216 or embodiment 217, wherein Z5 is the 2' O-methyl modified nucleoside.

220. The pharmaceutical composition of any one of embodiments 216-219, wherein Z6 is the 2' fluoro modified nucleoside.

221. The pharmaceutical composition of any one of embodiments 216-219, wherein Z6 is the 2' O-methyl modified nucleoside.

222. The pharmaceutical composition of any one of embodiments 192-221, comprising the pattern mN-Z5-mN-Z6-mN, wherein mN comprises the 2' O-methyl modified nucleoside and Z5 and Z6 are independently a 2' O-methyl modified nucleoside or a 2' fluoro modified nucleoside.

223. The pharmaceutical composition of embodiment 222, wherein the mN-Z5-mN-Z6-mN corresponds to nucleosides two to six of the sense strand, in a 5' to 3' direction.

224. The pharmaceutical composition of embodiment 222, wherein the mN-Z5-mN-Z6-mN corresponds to nucleosides ten to fourteen of the sense strand, in a 5' to 3' direction.

225. The pharmaceutical composition of embodiment 222, wherein the mN-Z5-mN-Z6-mN corresponds to nucleosides twelve to sixteen of the sense strand, in a 5' to 3' direction.

226. The pharmaceutical composition of embodiment 222, wherein the mN-Z5-mN-Z6-mN corresponds to nucleosides fourteen to eighteen of the sense strand, in a 5' to 3' direction.

227. The pharmaceutical composition of embodiment 222, wherein the mN-Z5-mN-Z6-mN corresponds to nucleosides sixteen to twenty of the sense strand, in a 5' to 3' direction.

228. The pharmaceutical composition of any one of embodiments 192-227, comprising the pattern mN-Z5-mN-Z6-mN-Z7-mN, wherein Z7 is a 2' O-methyl modified nucleoside or a 2' fluoro modified nucleoside.

229. The pharmaceutical composition of embodiment 228, wherein the mN-Z5-mN-Z6-mN-Z7-mN corresponds to nucleosides ten to sixteen of the sense strand, in a 5' to 3' direction.

230. The pharmaceutical composition of embodiment 228, wherein the mN-Z5-mN-Z6-mN-Z7-mN corresponds to nucleosides twelve to eighteen of the sense strand, in a 5' to 3' direction.

231. The pharmaceutical composition of embodiment 228, wherein the mN-Z5-mN-Z6-mN-Z7-mN corresponds to nucleosides fourteen to twenty of the sense strand, in a 5' to 3' direction.

232. The pharmaceutical composition of any one of embodiments 192-231, comprising the pattern mN-Z5-mN-Z6-mN-Z7-mN-Z8-mN, wherein Z8 is a 2' O-methyl modified nucleoside or a 2' fluoro modified nucleoside.

233. The pharmaceutical composition of embodiment 232, wherein the mN-Z5-mN-Z6-mN-Z7-mN-Z8-mN corresponds to nucleosides ten to eighteen of the sense strand, in a 5' to 3' direction.

234. The pharmaceutical composition of embodiment 232, wherein the mN-Z5-mN-Z6-mN-Z7-mN-Z8-mN corresponds to nucleosides twelve to twenty of the sense strand, in a 5' to 3' direction.

235. The pharmaceutical composition of any one of embodiments 192-234, comprising the pattern mN-Z5-mN-Z6-mN-Z7-mN-Z8-mN-Z9-mN, wherein Z9 is a 2' O-methyl modified nucleoside or a 2' fluoro modified nucleoside.

236. The pharmaceutical composition of embodiment 235, wherein the mN-Z5-mN-Z6-mN-Z7-mN-Z8-mN-Z9-mN corresponds to nucleosides ten to twenty of the sense strand, in a 5' to 3' direction.

237. The pharmaceutical composition of any one of embodiments 192-236, wherein the sense strand comprises at least two contiguous 2' O-methyl modified nucleosides.

238. The pharmaceutical composition of embodiment 237, wherein the at least two contiguous 2' O-methyl modified nucleosides is three contiguous 2' O-methyl modified nucleosides.

239. The pharmaceutical composition of embodiment 237, wherein the at least two contiguous 2' O-methyl modified nucleosides is four contiguous 2' O-methyl modified nucleosides.

240. The pharmaceutical composition of embodiment 237, wherein the at least two contiguous 2' O-methyl modified nucleosides is five contiguous 2' O-methyl modified nucleosides.

241. The pharmaceutical composition of embodiment 237, wherein the at least two contiguous 2' O-methyl modified nucleosides is six contiguous 2' O-methyl modified nucleosides.

242. The pharmaceutical composition of embodiment 237, wherein the at least two contiguous 2' O-methyl modified nucleosides is seven contiguous 2' O-methyl modified nucleosides.

243. The pharmaceutical composition of embodiment 237, wherein the at least two contiguous 2' O-methyl modified nucleosides is eight contiguous 2' O-methyl modified nucleosides.

244. The pharmaceutical composition of embodiment 237, wherein the at least two contiguous 2' O-methyl modified nucleosides is nine contiguous 2' O-methyl modified nucleosides.

245. The pharmaceutical composition of embodiment 237, wherein the at least two contiguous 2' O-methyl modified nucleosides is ten contiguous 2' O-methyl modified nucleosides.

246. The pharmaceutical composition of embodiment 237, wherein the at least two contiguous 2' O-methyl modified nucleosides is eleven contiguous 2' O-methyl modified nucleosides.

247. The pharmaceutical composition of embodiment 237, wherein the at least two contiguous 2' O-methyl modified nucleosides is twelve contiguous 2' O-methyl modified nucleosides.

248. The pharmaceutical composition of any one of embodiments 189-247, wherein the antisense strand of the siRNA comprises one or more 2' O-methyl modified nucleosides.

249. The pharmaceutical composition of embodiment 248, wherein the one or more 2' O-methyl modified nucleosides of the antisense strand is about 1, 2, 3, 4, 5, 6, 7, 8, 9, 10, 11, 12, 13, 14, 15, 16, 17, 18, 19, 20, or 21 2' O-methyl modified nucleosides.

250. The pharmaceutical composition of embodiment 249, wherein the one or more 2' O-methyl modified nucleosides of the antisense strand is about thirteen 2' O-methyl modified nucleosides.

251. The pharmaceutical composition of embodiment 249, wherein the one or more 2' O-methyl modified nucleosides of the antisense strand is about fifteen 2' O-methyl modified nucleosides.

252. The pharmaceutical composition of embodiment 249, wherein the one or more 2' O-methyl modified nucleosides of the antisense strand is about seventeen 2' O-methyl modified nucleosides.

253. The pharmaceutical composition of any one of embodiments 249-252, wherein the first nucleoside of the antisense strand comprises the 2' O-methyl modified nucleoside, in a 5' to 3' direction.

254. The pharmaceutical composition of any one of embodiments 249-253, wherein the third nucleoside of the antisense strand comprises the 2' O-methyl modified nucleoside, in a 5' to 3' direction.

255. The pharmaceutical composition of any one of embodiments 249-254, wherein the fourth nucleoside of the antisense strand comprises the 2' O-methyl modified nucleoside, in a 5' to 3' direction.

256. The pharmaceutical composition of any one of embodiments 249-255, wherein the fifth nucleoside of the antisense strand comprises the 2' O-methyl modified nucleoside, in a 5' to 3' direction.

257. The pharmaceutical composition of any one of embodiments 249-256, wherein the seventh nucleoside of the antisense strand comprises the 2' O-methyl modified nucleoside, in a 5' to 3' direction.

258. The pharmaceutical composition of any one of embodiments 249-257, wherein the eighth nucleoside of the antisense strand comprises the 2' O-methyl modified nucleoside, in a 5' to 3' direction.

259. The pharmaceutical composition of any one of embodiments 249-258, wherein the ninth nucleoside of the antisense strand comprises the 2' O-methyl modified nucleoside, in a 5' to 3' direction.

260. The pharmaceutical composition of any one of embodiments 249-259, wherein the tenth nucleoside of the antisense strand comprises the 2' O-methyl modified nucleoside, in a 5' to 3' direction.

261. The pharmaceutical composition of any one of embodiments 249-260, wherein the eleventh nucleoside of the antisense strand comprises the 2' O-methyl modified nucleoside, in a 5' to 3' direction.

262. The pharmaceutical composition of any one of embodiments 249-261, wherein the twelfth nucleoside of the antisense strand comprises the 2' O-methyl modified nucleoside, in a 5' to 3' direction.

263. The pharmaceutical composition of any one of embodiments 249-262, wherein the thirteenth nucleoside of the antisense strand comprises the 2' O-methyl modified nucleoside, in a 5' to 3' direction.

264. The pharmaceutical composition of any one of embodiments 249-263, wherein the fifteenth nucleoside of the antisense strand comprises the 2' O-methyl modified nucleoside, in a 5' to 3' direction.

265. The pharmaceutical composition of any one of embodiments 249-264, wherein the seventeenth nucleoside of the antisense strand comprises the 2' O-methyl modified nucleoside, in a 5' to 3' direction.

266. The pharmaceutical composition of any one of embodiments 249-265, wherein the eighteenth nucleoside of the antisense strand comprises the 2' O-methyl modified nucleoside, in a 5' to 3' direction.

267. The pharmaceutical composition of any one of embodiments 249-266, wherein the nineteenth nucleoside of the antisense strand comprises the 2' O-methyl modified nucleoside, in a 5' to 3' direction.

268. The pharmaceutical composition of any one of embodiments 249-267, wherein the twentieth nucleoside of the antisense strand comprises the 2' O-methyl modified nucleoside, in a 5' to 3' direction.

269. The pharmaceutical composition of any one of embodiments 249-268, wherein the twenty-first nucleoside of the antisense strand comprises the 2' O-methyl modified nucleoside, in a 5' to 3' direction.

270. The pharmaceutical composition of any one of embodiments 249-269, wherein the first, third, fifth, seventh, eleventh, twelfth, thirteenth, fifteenth, seventeenth, nineteenth, twentieth, and twenty-first nucleosides of the antisense strand comprises the 2' O-methyl modified nucleoside, in a 5' to 3' direction.

271. The pharmaceutical composition of any one of embodiments 249-270, wherein the antisense strand comprises at least two contiguous 2' O-methyl modified nucleosides.

272. The pharmaceutical composition of embodiment 271, wherein the at least two contiguous 2' O-methyl modified nucleosides is three contiguous 2' O-methyl modified nucleosides.

273. The pharmaceutical composition of embodiment 271, wherein the at least two contiguous 2' O-methyl modified nucleosides is four contiguous 2' O-methyl modified nucleosides.

274. The pharmaceutical composition of embodiment 271, wherein the at least two contiguous 2' O-methyl modified nucleosides is five contiguous 2' O-methyl modified nucleosides.

275. The pharmaceutical composition of embodiment 271, wherein the at least two contiguous 2' O-methyl modified nucleosides is six contiguous 2' O-methyl modified nucleosides.

276. The pharmaceutical composition of embodiment 271, wherein the at least two contiguous 2' O-methyl modified nucleosides is seven contiguous 2' O-methyl modified nucleosides.

277. The pharmaceutical composition of any one of embodiments 248-276, wherein the antisense strand comprises a first sequence comprising at least two contiguous 2' O-methyl modified nucleosides and a second sequence comprising at least two contiguous 2' O-methyl modified nucleosides.

278. The pharmaceutical composition of embodiment 277, wherein the first sequence comprises at least three contiguous 2' O-methyl modified nucleosides, and the second sequence comprises at least three contiguous 2' O-methyl modified nucleosides.

279. The pharmaceutical composition of embodiment 277, wherein the first sequence comprises three contiguous 2' O-methyl modified nucleosides, and the second sequence comprises three contiguous 2' O-methyl modified nucleosides.

280. The pharmaceutical composition of embodiment 277, wherein the first sequence comprises four contiguous 2' O-methyl modified nucleosides, and the second sequence comprises five contiguous 2' O-methyl modified nucleosides.

281. The pharmaceutical composition of embodiment 277, wherein the first sequence comprises seven contiguous 2' O-methyl modified nucleosides, and the second sequence comprises five contiguous 2' O-methyl modified nucleosides.

282. The pharmaceutical composition of embodiment 277, wherein the first sequence comprises at least four contiguous 2' O-methyl modified nucleosides.

283. The pharmaceutical composition of embodiment 277, wherein the first sequence comprises at least five contiguous 2' O-methyl modified nucleosides.

284. The pharmaceutical composition of embodiment 277, wherein the first sequence comprises at least six contiguous 2' O-methyl modified nucleosides.

285. The pharmaceutical composition of embodiment 277, wherein the first sequence comprises at least seven contiguous 2' O-methyl modified nucleosides.

286. The pharmaceutical composition of any one of embodiments 282-285, wherein the second sequence comprises at least four contiguous 2' O-methyl modified nucleosides.

287. The pharmaceutical composition of any one of embodiments 282-285, wherein the second sequence comprises at least five contiguous 2' O-methyl modified nucleosides.

288. The pharmaceutical composition of any one of embodiments 282-285, wherein the second sequence comprises at least six contiguous 2' O-methyl modified nucleosides.

289. The pharmaceutical composition of any one of embodiments 282-285, wherein the second sequence comprises at least seven contiguous 2' O-methyl modified nucleosides.

290. The pharmaceutical composition of any one of embodiments 113-289, wherein the sense strand comprises a ribose.

291. The pharmaceutical composition of embodiment 290, wherein the sense strand comprises about 1, 2, 3, 4, 5, 6, 7, 8, 9, 10, 11, 12, 13, 14, 15, 16, 17, 18, 19, 20, or 21 ribose.

292. The pharmaceutical composition of embodiment 290 or embodiment 291, wherein the first nucleoside of the sense strand comprises the ribose, in a 5' to 3' direction.

293. The pharmaceutical composition of any one of embodiments 290-292, wherein the second nucleoside of the sense strand comprises the ribose, in a 5' to 3' direction.

294. The pharmaceutical composition of any one of embodiments 290-293, wherein the third nucleoside of the sense strand comprises the ribose, in a 5' to 3' direction.

295. The pharmaceutical composition of any one of embodiments 290-294, wherein the fourth nucleoside of the sense strand comprises the ribose, in a 5' to 3' direction.

296. The pharmaceutical composition of any one of embodiments 290-295, wherein the fifth nucleoside of the sense strand comprises the ribose, in a 5' to 3' direction.

297. The pharmaceutical composition of any one of embodiments 290-296, wherein the sixth nucleoside of the sense strand comprises the ribose, in a 5' to 3' direction.

298. The pharmaceutical composition of any one of embodiments 290-297, wherein the seventh nucleoside of the sense strand comprises the ribose, in a 5' to 3' direction.

299. The pharmaceutical composition of any one of embodiments 290-298, wherein the eighth nucleoside of the sense strand comprises the ribose, in a 5' to 3' direction.

300. The pharmaceutical composition of any one of embodiments 290-299, wherein the ninth nucleoside of the sense strand comprises the ribose, in a 5' to 3' direction.

301. The pharmaceutical composition of any one of embodiments 290-300, wherein the tenth nucleoside of the sense strand comprises the ribose, in a 5' to 3' direction.

302. The pharmaceutical composition of any one of embodiments 290-301, wherein the eleventh nucleoside of the sense strand comprises the ribose, in a 5' to 3' direction.

303. The pharmaceutical composition of any one of embodiments 290-302, wherein the twelfth nucleoside of the sense strand comprises the ribose, in a 5' to 3' direction.

304. The pharmaceutical composition of any one of embodiments 290-303, wherein the thirteenth nucleoside of the sense strand comprises the ribose, in a 5' to 3' direction.

305. The pharmaceutical composition of any one of embodiments 290-304, wherein the fourteenth nucleoside of the sense strand comprises the ribose, in a 5' to 3' direction.

306. The pharmaceutical composition of any one of embodiments 290-305, wherein the fifteenth nucleoside of the sense strand comprises the ribose, in a 5' to 3' direction.

307. The pharmaceutical composition of any one of embodiments 290-306, wherein the sixteenth nucleoside of the sense strand comprises the ribose, in a 5' to 3' direction.

308. The pharmaceutical composition of any one of embodiments 290-307, wherein the seventeenth nucleoside of the sense strand comprises the ribose, in a 5' to 3' direction.

309. The pharmaceutical composition of any one of embodiments 290-308, wherein the eighteenth nucleoside of the sense strand comprises the ribose, in a 5' to 3' direction.

310. The pharmaceutical composition of any one of embodiments 290-309, wherein the nineteenth nucleoside of the sense strand comprises the ribose, in a 5' to 3' direction.

311. The pharmaceutical composition of any one of embodiments 290-310, wherein the twentieth nucleoside of the sense strand comprises the ribose, in a 5' to 3' direction.

312. The pharmaceutical composition of any one of embodiments 290-311, wherein the twenty-first nucleoside of the sense strand comprises the ribose, in a 5' to 3' direction.

313. The pharmaceutical composition of any one of embodiments 113-312, wherein the antisense strand comprises a ribose.

314. The pharmaceutical composition of embodiment 313, wherein the antisense strand comprises about 1, 2, 3, 4, 5, 6, 7, 8, 9, 10, 11, 12, 13, 14, 15, 16, 17, 18, 19, 20, or 21 ribose.

315. The pharmaceutical composition of embodiment 313 or embodiment 314, wherein the first nucleoside of the antisense strand comprises the ribose, in a 5' to 3' direction.

316. The pharmaceutical composition of any one of embodiments 313-315, wherein the second nucleoside of the antisense strand comprises the ribose, in a 5' to 3' direction.

317. The pharmaceutical composition of any one of embodiments 313-316, wherein the third nucleoside of the antisense strand comprises the ribose, in a 5' to 3' direction.

318. The pharmaceutical composition of any one of embodiments 313-317, wherein the fourth nucleoside of the antisense strand comprises the ribose, in a 5' to 3' direction.

319. The pharmaceutical composition of any one of embodiments 313-318, wherein the fifth nucleoside of the antisense strand comprises the ribose, in a 5' to 3' direction.

320. The pharmaceutical composition of any one of embodiments 313-319, wherein the sixth nucleoside of the antisense strand comprises the ribose, in a 5' to 3' direction.

321. The pharmaceutical composition of any one of embodiments 313-320, wherein the seventh nucleoside of the antisense strand comprises the ribose, in a 5' to 3' direction.

322. The pharmaceutical composition of any one of embodiments 313-321, wherein the eighth nucleoside of the antisense strand comprises the ribose, in a 5' to 3' direction.

323. The pharmaceutical composition of any one of embodiments 313-322, wherein the ninth nucleoside of the antisense strand comprises the ribose, in a 5' to 3' direction.

324. The pharmaceutical composition of any one of embodiments 313-323, wherein the tenth nucleoside of the sense antisense comprises the ribose, in a 5' to 3' direction.

325. The pharmaceutical composition of any one of embodiments 313-324, wherein the eleventh nucleoside of the antisense strand comprises the ribose, in a 5' to 3' direction.

326. The pharmaceutical composition of any one of embodiments 313-325, wherein the twelfth nucleoside of the antisense strand comprises the ribose, in a 5' to 3' direction.

327. The pharmaceutical composition of any one of embodiments 313-326, wherein the thirteenth nucleoside of the antisense strand comprises the ribose, in a 5' to 3' direction.

328. The pharmaceutical composition of any one of embodiments 313-327, wherein the fourteenth nucleoside of the antisense strand comprises the ribose, in a 5' to 3' direction.

329. The pharmaceutical composition of any one of embodiments 313-328, wherein the fifteenth nucleoside of the antisense strand comprises the ribose, in a 5' to 3' direction.

330. The pharmaceutical composition of any one of embodiments 313-329, wherein the sixteenth nucleoside of the antisense strand comprises the ribose, in a 5' to 3' direction.

331. The pharmaceutical composition of any one of embodiments 313-330, wherein the seventeenth nucleoside of the antisense strand comprises the ribose, in a 5' to 3' direction.

332. The pharmaceutical composition of any one of embodiments 313-331, wherein the eighteenth nucleoside of the antisense strand comprises the ribose, in a 5' to 3' direction.

333. The pharmaceutical composition of any one of embodiments 313-332, wherein the nineteenth nucleoside of the antisense strand comprises the ribose, in a 5' to 3' direction.

334. The pharmaceutical composition of any one of embodiments 313-333, wherein the twentieth nucleoside of the antisense strand comprises the ribose, in a 5' to 3' direction.

335. The pharmaceutical composition of any one of embodiments 313-334, wherein the twenty-first nucleoside of the antisense strand comprises the ribose, in a 5' to 3' direction.

336. The pharmaceutical composition of any one of embodiments 113-335, further comprising a lipid attached at either 3' or 5' terminus.

337. The pharmaceutical composition of embodiment 336, wherein the lipid comprises cholesterol, myristoyl, palmitoyl, stearoyl, lithocholoyl, docosanoyl, docosahexaenoyl, myristyl, palmityl stearyl, α-tocopherol, or a combination thereof.

338. The pharmaceutical composition of embodiment 336 or embodiment 337, wherein the lipid comprises a first lipid on the sense strand and a second lipid on the antisense strand.

339. The pharmaceutical composition of any one of embodiments 336-338, wherein the lipid is positioned on the sense strand.

340. The pharmaceutical composition of embodiment 339, wherein the lipid is positioned at the 5' end of the sense strand.

341. The pharmaceutical composition of embodiment 339, wherein the lipid is positioned at the 3' end of the sense strand.

342. The pharmaceutical composition of any one of embodiments 336-341, wherein the lipid is positioned on the antisense strand.

343. The pharmaceutical composition of embodiment 342, wherein the lipid is positioned at the 5' end of the antisense strand.

344. The pharmaceutical composition of embodiment 342, wherein the lipid is positioned at the 3' end of the antisense strand.

345. The pharmaceutical composition of any one of embodiments 113-344, wherein the sense strand and the antisense strand form a double-stranded RNA duplex.

346. The pharmaceutical composition of embodiment 345, wherein the double-stranded RNA duplex comprises from about 14 to about 30 nucleosides.

347. The pharmaceutical composition of embodiment 346, wherein the double-stranded RNA duplex comprises from about 17 to about 30 nucleosides.

348. The pharmaceutical composition of embodiment 347, wherein the double-stranded RNA duplex comprises about 21 nucleosides.

349. The pharmaceutical composition of any one of embodiments 345-348, wherein the double-stranded RNA duplex comprises at least one base pair.

350. The pharmaceutical composition of embodiment 349, wherein the first base pair of the double-stranded RNA duplex is an AU base pair.

351. The pharmaceutical composition of any one of embodiments 113-350, wherein the sense strand comprises pattern 1S: 5' fN s mN s fN-mN-fN-mN-fN-fN-fN-mN-fN-mN-fN-mN-fN-mN-fN-mN-fN s mN s mN 3' (SEQ ID NO: 11381), wherein "fN" is a 2' fluoro-modified nucleoside, "mN" is a 2' O-methyl modified nucleoside, "-" is a phosphodiester, and "s" is a phosphorothioate.

352. The pharmaceutical composition of any one of embodiments 113-350, wherein the sense strand comprises pattern 2S: 5' mN s mN s mN-mN-fN-mN-fN-fN-fN-mN-mN-mN-mN-mN-mN-mN-mN-mN-mN s mN s mN 3' (SEQ ID NO: 11382), wherein "fN" is a 2' fluoro-modified nucleoside, "mN" is a 2' O-methyl modified nucleoside, "-" is a phosphodiester, and "s" is a phosphorothioate.

353. The pharmaceutical composition of any one of embodiments 113-350, wherein the sense strand comprises pattern 3S: 5' mN s mN s mN-mN-fN-mN-fN-mN-fN-mN-mN-mN-mN-mN-mN-mN-mN-mN-mN s mN s mN 3' (SEQ ID NO: 11383), wherein "fN" is a 2' fluoro-modified nucleoside, "mN" is a 2' O-methyl modified nucleoside, "-" is a phosphodiester, and "s" is a phosphorothioate.

354. The pharmaceutical composition of any one of embodiments 113-350, wherein the sense strand comprises pattern 4S: 5' fN s mN s fN-mN-fN-mN-fN-fN-fN-mN-fN-mN-fN-mN-fN-mN-fN-mN-fN s mN s mN-N-Lipid 3' (SEQ ID NO: 11384), wherein "fN" is a 2' fluoro-modified nucleoside, "mN" is a 2' O-methyl modified nucleoside, "-" is a phosphodiester, "s" is a phosphorothioate, and N comprises one or more nucleosides.

355. The pharmaceutical composition of embodiment 354, wherein the one or more nucleosides is three nucleosides.

356. The pharmaceutical composition of embodiment 354 or 355, wherein each of the one or more nucleosides independently comprise a ribose or deoxyribose.

357. The pharmaceutical composition of any one of embodiments 113-350, wherein the sense strand comprises pattern 5S: 5' mN s mN s mN-mN-fN-mN-fN-fN-fN-mN-mN-mN-mN-mN-mN-mN-mN-mN-mN s mN s mN-N-Lipid 3' (SEQ ID NO: 11385), wherein "fN" is a 2' fluoro-modified nucleoside, "mN" is a 2' O-methyl modified nucleoside, "-" is a phosphodiester, "s" is a phosphorothioate, and N comprises one or more nucleosides.

358. The pharmaceutical composition of embodiment 357, wherein the one or more nucleosides is three nucleosides.

359. The pharmaceutical composition of embodiment 357 or 358, wherein each of the one or more nucleosides independently comprise a ribose or deoxyribose.

360. The pharmaceutical composition of any one of embodiments 113-359, wherein the antisense strand comprises pattern 1AS: 5' mN s fN s mN-fN-mN-fN-mN-fN-mN-fN-mN-mN-mN-fN-mN-fN-mN-fN-mN s mN s mN 3' (SEQ ID NO: 11386), wherein "fN" is a 2' fluoro-modified nucleoside, "mN" is a 2' O-methyl modified nucleoside, "-" is a phosphodiester, and "s" is a phosphorothioate.

361. The pharmaceutical composition of any one of embodiments 113-359, wherein the antisense strand comprises pattern 2AS: 5' mN s fN s mN-mN-mN-fN-mN-fN-fN-mN-mN-mN-mN-fN-mN-fN-mN-mN-mN s mN s mN 3' (SEQ ID NO: 11387), wherein "fN" is a 2' fluoro-modified nucleoside, "mN" is a 2' O-methyl modified nucleoside, "-" is a phosphodiester, and "s" is a phosphorothioate.

362. The pharmaceutical composition of any one of embodiments 113-359, wherein the antisense strand comprises pattern 3AS: 5' mN s fN s mN-mN-mN-fN-mN-mN-mN-mN-mN-mN-mN-fN-mN-fN-mN-mN-mN s mN s mN 3' (SEQ ID NO: 11388), wherein "fN" is a 2' fluoro-modified nucleoside, "mN" is a 2' O-methyl modified nucleoside, "-" is a phosphodiester, and "s" is a phosphorothioate.

363. The pharmaceutical composition of any one of embodiments 113-359, wherein the antisense strand comprises pattern 4AS: 5' mN s fN s mN-fN-mN-fN-mN-mN-mN-mN-mN-mN-mN-fN-mN-fN-mN-mN-mN s mN s mN 3' (SEQ ID NO: 11389), wherein "fN" is a 2' fluoro-modified nucleoside, "mN" is a 2' O-methyl modified nucleoside, "-" is a phosphodiester, and "s" is a phosphorothioate.

364. The pharmaceutical composition of any one of embodiments 113-350, wherein the sense strand comprises pattern 1S and the antisense strand comprises pattern 1AS.

365. The pharmaceutical composition of any one of embodiments 113-350, wherein the sense strand comprises pattern 2S and the antisense strand comprises pattern 2AS.

366. The pharmaceutical composition of any one of embodiments 113-350, wherein the sense strand comprises pattern 3S and the antisense strand comprises pattern 3AS.

367. The pharmaceutical composition of any one of embodiments 113-350, wherein the sense strand comprises pattern 4S and the antisense strand comprises pattern 4AS.

368. A method of treating an eye disease or disorder comprising administering to the eye of a patient in need thereof a short interfering nucleic acid molecule (siRNA) that targets a portion of mRNA encoding ANGPTL7, wherein the siRNA comprises a double-stranded nucleic acid region comprising a sense strand and an antisense strand, and wherein there is greater than 90% sequence identity or greater than 90% sequence complementarity between said double-stranded nucleic acid region of siRNA and the portion of mRNA encoding ANGPTL7 that is targeted by the siRNA 369. The method of embodiment 368, wherein the eye disease or disorder is characterized by increased intraocular pressure.

370. The method of embodiment 368 or embodiment 369, wherein the siRNA is administered to the eye of the patient in an effective amount that reduces IOP in the eye of the patient.

371. The method of embodiment 370, wherein the siRNA molecule reduces intraocular pressure by at least 5%, at least 10%, at least 15%, at least 20%, at least 25%, at least 30% relative to a pre-treatment value of intraocular pressure in the eye of the patient.

372. The method of any of embodiments 368-371, wherein the siRNA is formulated for topical administration to the eye.

373. The method of any of embodiments 368-372, wherein the eye disease or disorder comprises glaucoma.

374. The method of embodiment 373, wherein the glaucoma is selected from the group consisting of optic nerve damage comprises primary open-angle glaucoma, primary angle-closure glaucoma, normal-tension glaucoma, pigmentary glaucoma, exfoliation glaucoma, juvenile glaucoma, congenital glaucoma, inflammatory glaucoma, phacogenic glaucoma, glaucoma secondary to intraocular hemorrhage, traumatic glaucoma, neovascular glaucoma, drug-induced glaucoma, toxic glaucoma, and absolute glaucoma.

375. The method of embodiment 374, wherein the eye disease or disorder is selected from the group consisting a disease or disorder associated with optic nerve damage, a disease or disorder associated with intraocular pressure, a degenerative retinal disease or disorder, an inflammatory eye disease or disorder, an allergic eye disease or disorder.

376. The method of any of embodiments 368-375, wherein the siRNA has a length of 17-30 nucleotide pairs.

377. The method of any of embodiments 368-376, wherein the sense strand and antisense strand each have 17-30 nucleotides.

378. The method of any of embodiments 368-377, wherein the sense strand comprises a sequence at least about 80%, 85%, 90%, 95%, or 100% identical to a sequence selected from SEQ ID NOS: 1-4412.

379. The method of any of embodiments 368-378, wherein the antisense strand comprises a sequence at least about 80%, 85%, 90%, 95%, or 100% identical to the reverse complement of the sense strand.

380. The method of any of embodiments 368-379, wherein the antisense strand comprises a sequence at least about 80%, 85%, 90%, 95%, or 100% identical to a sequence selected from SEQ ID NOS: 1-4412.

381. The method of any of embodiments 368-380, wherein the sequence of the sense strand comprises SEQ ID NO: 11089 and the sequence of the antisense strand comprises SEQ ID NO: 11090.

382. The method of any of embodiments 368-381, comprising a modified internucleoside linkage.

383. The method of embodiment 382, wherein the modified internucleoside linkage comprises alkylphosphonate, phosphorothioate, methylphosphonate, phosphorodithioate, alkylphosphonothioate, phosphoramidate, carbamate, carbonate, phosphate triester, acetamidate, or carboxymethyl ester, or a combination thereof.

384. The method of embodiment 383, wherein the modified internucleoside linkage comprises one or more phosphorothioate linkages.

385. The method of embodiment 384, wherein the one or more phosphorothioate linkages is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 phosphorothioate linkages.

386. The method of embodiment 384 or embodiment 385, wherein the sense strand of the siRNA comprises one or more phosphorothioate linkages.

387. The method of embodiment 386, wherein the one or more phosphorothioate linkages of the sense strand is about 1, 2, 3, 4, 5, 6, 7, 8, 9, 10, 11, 12, 13, 14, 15, 16, 17, 18, 19, 20, or 21 phosphorothioate linkages.

388. The method of embodiment 387, wherein the one or more phosphorothioate linkages of the sense strand is about 1, 2, 3, 4, or 5 phosphorothioate linkages.

389. The method of embodiment 388, wherein the one or more phosphorothioate linkages of the sense strand is about 4 phosphorothioate linkages.

390. The method of any one of embodiments 382-389, wherein the sense strand comprises a phosphorothioate linkage between the first nucleoside and the second nucleoside of the sense strand, in a 5' to 3' direction.

391. The method of any one of embodiments 382-390, wherein the sense strand comprises a phosphorothioate linkage between the second nucleoside and the third nucleoside of the sense strand, in a 5' to 3' direction.

392. The method of any one of embodiments 382-391, wherein the sense strand comprises a phosphorothioate linkage between the nineteenth nucleoside and the twentieth nucleoside of the sense strand, in a 5' to 3' direction.

393. The method of any one of embodiments 382-392, wherein the sense strand comprises a phosphorothioate linkage between the twentieth nucleoside and the twenty-first nucleoside of the sense strand, in a 5' to 3' direction.

394. The method of any one of embodiments 384-393, wherein the antisense strand of the siRNA comprises one or more phosphorothioate linkages.

395. The method of embodiment 394, wherein the one or more phosphorothioate linkages of the antisense strand is about 1, 2, 3, 4, 5, 6, 7, 8, 9, 10, 11, 12, 13, 14, 15, 16, 17, 18, 19, 20, or 21 phosphorothioate linkages.

396. The method of embodiment 395, wherein the one or more phosphorothioate linkages of the antisense strand is about 1, 2, 3, 4, or 5 phosphorothioate linkages.

397. The method of embodiment 396, wherein the one or more phosphorothioate linkages of the antisense strand is about 4 phosphorothioate linkages.

398. The method of any one of embodiments 394-397, wherein the antisense strand comprises a phosphorothioate linkage between the first nucleoside and the second nucleoside of the antisense strand, in a 5' to 3' direction.

399. The method of any one of embodiments 394-398, wherein the antisense strand comprises a phosphorothioate linkage between the second nucleoside and the third nucleoside of the antisense strand, in a 5' to 3' direction.

400. The method of any one of embodiments 394-399, wherein the antisense strand comprises a phosphorothioate linkage between the nineteenth nucleoside and the twentieth nucleoside of the sense strand, in a 5' to 3' direction.

401. The method of any one of embodiments 394-400, wherein the antisense strand comprises a phosphorothioate linkage between the twentieth nucleoside and the twenty-first nucleoside of the sense strand, in a 5' to 3' direction.

402. The method of any one of embodiments 368-401, comprising a modified nucleoside.

403. The method of embodiment 402, wherein the modified nucleoside comprises a locked nucleic acid (LNA), hexitol nucleic acid (HLA), cyclohexene nucleic acid (CeNA), 2'-methoxyethyl, 2'-O-alkyl, 2'-O-allyl, 2'-O-allyl, 2'-fluoro, or 2'-deoxy, or a combination thereof.

404. The method of embodiment 403, wherein the modified nucleoside comprises a of 2' O-methyl nucleoside, 2'-deoxyfluoro nucleoside, 2'-O—N-methylacetamido (2'-O-NMA) nucleoside, a 2'-O-dimethylaminoethoxyethyl (2'-O-DMAEOE) nucleoside, 2'-O-aminopropyl(2'-0-AP) nucleoside, or 2'-ara-F, or a combination thereof.

405. The method of embodiment 403, wherein the modified nucleoside comprises one or more 2' fluoro modified nucleosides.

406. The method of embodiment 405, wherein the one or more 2' fluoro modified nucleosides is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 2' fluoro modified nucleosides.

407. The method of embodiment 405 or embodiment 406, wherein the sense strand of the siRNA comprises one or more 2' fluoro modified nucleosides.

408. The method of embodiment 407, wherein the one or more 2' fluoro modified nucleosides of the sense strand is about 1, 2, 3, 4, 5, 6, 7, 8, 9, 10, 11, 12, 13, 14, 15, 16, 17, 18, 19, 20, or 21 2' fluoro modified nucleosides.

409. The method of embodiment 408, wherein the one or more 2' fluoro modified nucleosides of the sense strand is about eleven 2' fluoro modified nucleosides.

410. The method of embodiment 408, wherein the one or more 2' fluoro modified nucleosides of the sense strand is about four 2' fluoro modified nucleosides.

411. The method of embodiment 408, wherein the one or more 2' fluoro modified nucleosides of the sense strand is about three 2' fluoro modified nucleosides.

412. The method of any one of embodiments 407-411, wherein the first nucleoside of the sense strand comprises the 2' fluoro modified nucleoside, in a 5' to 3' direction.

413. The method of any one of embodiments 407-412, wherein the third nucleoside of the sense strand comprises the 2' fluoro modified nucleoside, in a 5' to 3' direction.

414. The method of any one of embodiments 407-413, wherein the fifth nucleoside of the sense strand comprises the 2' fluoro modified nucleoside, in a 5' to 3' direction.

415. The method of any one of embodiments 407-414, wherein the seventh nucleoside of the sense strand comprises the 2' fluoro modified nucleoside, in a 5' to 3' direction.

416. The method of any one of embodiments 407-415, wherein the eighth nucleoside of the sense strand comprises the 2' fluoro modified nucleoside, in a 5' to 3' direction.

417. The method of any one of embodiments 407-416, wherein the ninth nucleoside of the sense strand comprises the 2' fluoro modified nucleoside, in a 5' to 3' direction.

418. The method of any one of embodiments 407-417, wherein the eleventh nucleoside of the sense strand comprises the 2' fluoro modified nucleoside, in a 5' to 3' direction.

419. The method of any one of embodiments 407-418, wherein the thirteenth nucleoside of the sense strand comprises the 2' fluoro modified nucleoside, in a 5' to 3' direction.

420. The method of any one of embodiments 407-419, wherein the fifteenth nucleoside of the sense strand comprises the 2' fluoro modified nucleoside, in a 5' to 3' direction.

421. The method of any one of embodiments 407-420, wherein the seventeenth nucleoside of the sense strand comprises the 2' fluoro modified nucleoside, in a 5' to 3' direction.

422. The method of any one of embodiments 407-421, wherein the nineteenth nucleoside of the sense strand comprises the 2' fluoro modified nucleoside, in a 5' to 3' direction.

423. The method of any one of embodiments 407-422, wherein the fifth, seventh, and ninth nucleosides of the sense strand comprises the 2' fluoro modified nucleoside, in a 5' to 3' direction.

424. The method of any one of embodiments 407-423, comprising the pattern fN-Z1-fN-Z2-fN, wherein fN comprises the 2' fluoro modified nucleoside and Z1 and Z2 are independently a 2' O-methyl modified nucleoside or a 2' fluoro modified nucleoside.

425. The method of embodiment 424, wherein the fN-Z1-fN-Z2-fN corresponds to nucleosides five to nine of the sense strand, in a 5' to 3' direction.

426. The method of any one of embodiments 407-425, wherein the sense strand comprises at least two contiguous 2' fluoro modified nucleosides.

427. The method of embodiment 426, wherein the at least two contiguous 2' fluoro modified nucleosides is two contiguous 2' fluoro modified nucleosides.

428. The method of embodiment 426, wherein the at least two contiguous 2' fluoro modified nucleosides is three contiguous 2' fluoro modified nucleosides.

429. The method of any one of embodiments 405-428, wherein the antisense strand of the siRNA comprises one or more 2' fluoro modified nucleosides.

430. The method of embodiment 429, wherein the one or more 2' fluoro modified nucleosides of the antisense strand is about 1, 2, 3, 4, 5, 6, 7, 8, 9, 10, 11, 12, 13, 14, 15, 16, 17, 18, 19, 20, or 21 2' fluoro modified nucleosides.

431. The method of embodiment 430, wherein the one or more 2' fluoro modified nucleosides of the antisense strand is about eight 2' fluoro modified nucleosides.

432. The method of embodiment 430, wherein the one or more 2' fluoro modified nucleosides of the antisense strand is about six 2' fluoro modified nucleosides.

433. The method of embodiment 430, wherein the one or more 2' fluoro modified nucleosides of the antisense strand is about five 2' fluoro modified nucleosides.

434. The method of embodiment 430, wherein the one or more 2' fluoro modified nucleosides of the antisense strand is about four 2' fluoro modified nucleosides.

435. The method of any one of embodiments 429-434, wherein the second nucleoside of the antisense strand comprises the 2' fluoro modified nucleoside, in a 5' to 3' direction.

436. The method of any one of embodiments 429-435, wherein the fourth nucleoside of the antisense strand comprises the 2' fluoro modified nucleoside, in a 5' to 3' direction.

437. The method of any one of embodiments 429-436, wherein the sixth nucleoside of the antisense strand comprises the 2' fluoro modified nucleoside, in a 5' to 3' direction.

438. The method of any one of embodiments 429-437, wherein the eighth nucleoside of the antisense strand comprises the 2' fluoro modified nucleoside, in a 5' to 3' direction.

439. The method of any one of embodiments 429-438, wherein the ninth nucleoside of the antisense strand comprises the 2' fluoro modified nucleoside, in a 5' to 3' direction.

440. The method of any one of embodiments 429-439, wherein the tenth nucleoside of the antisense strand comprises the 2' fluoro modified nucleoside, in a 5' to 3' direction.

441. The method of any one of embodiments 429-440, wherein the fourteenth nucleoside of the antisense strand comprises the 2' fluoro modified nucleoside, in a 5' to 3' direction.

442. The method of any one of embodiments 429-441, wherein the sixteenth nucleoside of the antisense strand comprises the 2' fluoro modified nucleoside, in a 5' to 3' direction.

443. The method of any one of embodiments 429-442, wherein the eighteenth nucleoside of the antisense strand comprises the 2' fluoro modified nucleoside, in a 5' to 3' direction.

444. The method of any one of embodiments 429-443, wherein the second and fourteenth nucleosides of the antisense strand comprises the 2' fluoro modified nucleoside, in a 5' to 3' direction.

445. The method of any one of embodiments 429-444, wherein the second, sixth, fourteenth, and sixteenth nucleosides of the antisense strand comprises the 2' fluoro modified nucleoside, in a 5' to 3' direction.

446. The method of any one of embodiments 429-445, comprising the pattern Z3-fN-Z4-fN, wherein fN comprises the 2' fluoro modified nucleoside and Z3 and Z4 are independently a 2' O-methyl modified nucleoside or a 2' fluoro modified nucleoside.

447. The method of embodiment 446, wherein the Z3-fN-Z4-fN corresponds to nucleosides thirteen to sixteen of the antisense strand, in a 5' to 3' direction.

448. The method of any one of embodiments 404-447, wherein the modified nucleoside comprises a 2' O-alkyl modified nucleoside.

449. The method of embodiment 448, wherein the 2'-O-alkyl modified nucleoside comprises one or more 2' O-methyl modified nucleosides.

450. The method of embodiment 449, wherein the one or more 2' O-methyl modified nucleosides is about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 2' O-methyl modified nucleosides.

451. The method of any one of embodiments 448-450, wherein the sense strand of the siRNA comprises one or more 2' O-methyl modified nucleosides.

452. The method of embodiment 451, wherein the one or more 2' O-methyl modified nucleosides of the sense strand is about 1, 2, 3, 4, 5, 6, 7, 8, 9, 10, 11, 12, 13, 14, 15, 16, 17, 18, 19, 20, or 21 2' O-methyl modified nucleosides.

453. The method of embodiment 452, wherein the one or more 2' O-methyl modified nucleosides of the sense strand is about ten 2' O-methyl modified nucleosides.

454. The method of embodiment 452, wherein the one or more 2' O-methyl modified nucleosides of the sense strand is about seventeen 2' O-methyl modified nucleosides.

455. The method of embodiment 452, wherein the one or more 2' O-methyl modified nucleosides of the sense strand is about eighteen 2' O-methyl modified nucleosides.

456. The method of any one of embodiments 449-455, wherein the first nucleoside of the sense strand comprises the 2' O-methyl modified nucleoside, in a 5' to 3' direction.

457. The method of any one of embodiments 449-456, wherein the second nucleoside of the sense strand comprises the 2' O-methyl modified nucleoside, in a 5' to 3' direction.

458. The method of any one of embodiments 449-457, wherein the third nucleoside of the sense strand comprises the 2' O-methyl modified nucleoside, in a 5' to 3' direction.

459. The method of any one of embodiments 449-458, wherein the fourth nucleoside of the sense strand comprises the 2' O-methyl modified nucleoside, in a 5' to 3' direction.

460. The method of any one of embodiments 449-459, wherein the sixth nucleoside of the sense strand comprises the 2' O-methyl modified nucleoside, in a 5' to 3' direction.

461. The method of any one of embodiments 449-460, wherein the eighth nucleoside of the sense strand comprises the 2' O-methyl modified nucleoside, in a 5' to 3' direction.

462. The method of any one of embodiments 449-461, wherein the tenth nucleoside of the sense strand comprises the 2' O-methyl modified nucleoside, in a 5' to 3' direction.

463. The method of any one of embodiments 449-462, wherein the eleventh nucleoside of the sense strand comprises the 2' O-methyl modified nucleoside, in a 5' to 3' direction.

464. The method of any one of embodiments 449-463, wherein the twelfth nucleoside of the sense strand comprises the 2' O-methyl modified nucleoside, in a 5' to 3' direction.

465. The method of any one of embodiments 449-464, wherein the thirteenth nucleoside of the sense strand comprises the 2' O-methyl modified nucleoside, in a 5' to 3' direction.

466. The method of any one of embodiments 449-465, wherein the fourteenth nucleoside of the sense strand comprises the 2' O-methyl modified nucleoside, in a 5' to 3' direction.

467. The method of any one of embodiments 449-466, wherein the fifteenth nucleoside of the sense strand comprises the 2' O-methyl modified nucleoside, in a 5' to 3' direction.

468. The method of any one of embodiments 449-467, wherein the sixteenth nucleoside of the sense strand comprises the 2' O-methyl modified nucleoside, in a 5' to 3' direction.

469. The method of any one of embodiments 449-468, wherein the seventeenth nucleoside of the sense strand comprises the 2' O-methyl modified nucleoside, in a 5' to 3' direction.

470. The method of any one of embodiments 449-469, wherein the eighteenth nucleoside of the sense strand comprises the 2' O-methyl modified nucleoside, in a 5' to 3' direction.

471. The method of any one of embodiments 449-470, wherein the nineteenth nucleoside of the sense strand comprises the 2' O-methyl modified nucleoside, in a 5' to 3' direction.

472. The method of any one of embodiments 449-471, wherein the twentieth nucleoside of the sense strand comprises the 2' O-methyl modified nucleoside, in a 5' to 3' direction.

473. The method of any one of embodiments 449-472, wherein the twenty-first nucleoside of the sense strand comprises the 2' O-methyl modified nucleoside, in a 5' to 3' direction.

474. The method of any one of embodiments 449-473, wherein the second, fourth, sixth, tenth, twelfth, fourteenth, and sixteenth, eighteenth, twentieth, and twenty-first nucleosides of the sense strand comprises the 2' O-methyl modified nucleoside, in a 5' to 3' direction.

475. The method of any one of embodiments 449-474, comprising the pattern mN-Z5-mN-Z6, wherein mN comprises the 2' O-methyl modified nucleoside and Z5 and Z6 are independently a 2' O-methyl modified nucleoside or a 2' fluoro modified nucleoside.

476. The method of embodiment 475, wherein the mN-Z5-mN-Z6-mN corresponds to nucleosides four to seven of the sense strand, in a 5' to 3' direction.

477. The method of embodiment 475 or embodiment 476, wherein Z5 is the 2' fluoro modified nucleoside.

478. The method of embodiment 475 or embodiment 476, wherein Z5 is the 2' O-methyl modified nucleoside.

479. The method of any one of embodiments 475-478, wherein Z6 is the 2' fluoro modified nucleoside.

480. The method of any one of embodiments 475-478, wherein Z6 is the 2' O-methyl modified nucleoside.

481. The method of any one of embodiments 449-480, comprising the pattern mN-Z5-mN-Z6-mN, wherein mN comprises the 2' O-methyl modified nucleoside and Z5 and Z6 are independently a 2' O-methyl modified nucleoside or a 2' fluoro modified nucleoside.

482. The method of embodiment 481, wherein the mN-Z5-mN-Z6-mN corresponds to nucleosides two to six of the sense strand, in a 5' to 3' direction.

483. The method of embodiment 481, wherein the mN-Z5-mN-Z6-mN corresponds to nucleosides ten to fourteen of the sense strand, in a 5' to 3' direction.

484. The method of embodiment 481, wherein the mN-Z5-mN-Z6-mN corresponds to nucleosides twelve to sixteen of the sense strand, in a 5' to 3' direction.

485. The method of embodiment 481, wherein the mN-Z5-mN-Z6-mN corresponds to nucleosides fourteen to eighteen of the sense strand, in a 5' to 3' direction.

486. The method of embodiment 481, wherein the mN-Z5-mN-Z6-mN corresponds to nucleosides sixteen to twenty of the sense strand, in a 5' to 3' direction.

487. The method of any one of embodiments 449-486, comprising the pattern mN-Z5-mN-Z6-mN-Z7-mN, wherein Z7 is a 2' O-methyl modified nucleoside or a 2' fluoro modified nucleoside.

488. The method of embodiment 487, wherein the mN-Z5-mN-Z6-mN-Z7-mN corresponds to nucleosides ten to sixteen of the sense strand, in a 5' to 3' direction.

489. The method of embodiment 488, wherein the mN-Z5-mN-Z6-mN-Z7-mN corresponds to nucleosides twelve to eighteen of the sense strand, in a 5' to 3' direction.

490. The method of embodiment 488, wherein the mN-Z5-mN-Z6-mN-Z7-mN corresponds to nucleosides fourteen to twenty of the sense strand, in a 5' to 3' direction.

491. The method of any one of embodiments 449-490, comprising the pattern mN-Z5-mN-Z6-mN-Z7-mN-Z8-mN, wherein Z8 is a 2' O-methyl modified nucleoside or a 2' fluoro modified nucleoside.

492. The method of embodiment 491, wherein the mN-Z5-mN-Z6-mN-Z7-mN-Z8-mN corresponds to nucleosides ten to eighteen of the sense strand, in a 5' to 3' direction.

493. The method of embodiment 491, wherein the mN-Z5-mN-Z6-mN-Z7-mN-Z8-mN corresponds to nucleosides twelve to twenty of the sense strand, in a 5' to 3' direction.

494. The method of any one of embodiments 449-493, comprising the pattern mN-Z5-mN-Z6-mN-Z7-mN-Z8-mN-Z9-mN, wherein Z9 is a 2' O-methyl modified nucleoside or a 2' fluoro modified nucleoside.

495. The method of embodiment 494, wherein the mN-Z5-mN-Z6-mN-Z7-mN-Z8-mN-Z9-mN corresponds to nucleosides ten to twenty of the sense strand, in a 5' to 3' direction.

496. The method of any one of embodiments 449-495, wherein the sense strand comprises at least two contiguous 2' O-methyl modified nucleosides.

497. The method of embodiment 496, wherein the at least two contiguous 2' O-methyl modified nucleosides is three contiguous 2' O-methyl modified nucleosides.

498. The method of embodiment 496, wherein the at least two contiguous 2' O-methyl modified nucleosides is four contiguous 2' O-methyl modified nucleosides.

499. The method of embodiment 496, wherein the at least two contiguous 2' O-methyl modified nucleosides is five contiguous 2' O-methyl modified nucleosides.

500. The method of embodiment 496, wherein the at least two contiguous 2' O-methyl modified nucleosides is six contiguous 2' O-methyl modified nucleosides.

501. The method of embodiment 496, wherein the at least two contiguous 2' O-methyl modified nucleosides is seven contiguous 2' O-methyl modified nucleosides.

502. The method of embodiment 496, wherein the at least two contiguous 2' O-methyl modified nucleosides is eight contiguous 2' O-methyl modified nucleosides.

503. The method of embodiment 496, wherein the at least two contiguous 2' O-methyl modified nucleosides is nine contiguous 2' O-methyl modified nucleosides.

504. The method of embodiment 496, wherein the at least two contiguous 2' O-methyl modified nucleosides is ten contiguous 2' O-methyl modified nucleosides.

505. The method of embodiment 496, wherein the at least two contiguous 2' O-methyl modified nucleosides is eleven contiguous 2' O-methyl modified nucleosides.

506. The method of embodiment 496, wherein the at least two contiguous 2' O-methyl modified nucleosides is twelve contiguous 2' O-methyl modified nucleosides.

507. The method of any one of embodiments 449-506, wherein the antisense strand of the siRNA comprises one or more 2' O-methyl modified nucleosides.

508. The method of embodiment 507, wherein the one or more 2' O-methyl modified nucleosides of the antisense strand is about 1, 2, 3, 4, 5, 6, 7, 8, 9, 10, 11, 12, 13, 14, 15, 16, 17, 18, 19, 20, or 21 2' O-methyl modified nucleosides.

509. The method of embodiment 508, wherein the one or more 2' O-methyl modified nucleosides of the antisense strand is about thirteen 2' O-methyl modified nucleosides.

510. The method of embodiment 508, wherein the one or more 2' O-methyl modified nucleosides of the antisense strand is about fifteen 2' O-methyl modified nucleosides.

511. The method of embodiment 508, wherein the one or more 2' O-methyl modified nucleosides of the antisense strand is about seventeen 2' O-methyl modified nucleosides.

512. The method of any one of embodiments 507-511, wherein the first nucleoside of the antisense strand comprises the 2' O-methyl modified nucleoside, in a 5' to 3' direction.

513. The method of any one of embodiments 507-512, wherein the third nucleoside of the antisense strand comprises the 2' O-methyl modified nucleoside, in a 5' to 3' direction.

514. The method of any one of embodiments 507-513, wherein the fourth nucleoside of the antisense strand comprises the 2' O-methyl modified nucleoside, in a 5' to 3' direction.

515. The method of any one of embodiments 507-514, wherein the fifth nucleoside of the antisense strand comprises the 2' O-methyl modified nucleoside, in a 5' to 3' direction.

516. The method of any one of embodiments 507-515, wherein the seventh nucleoside of the antisense strand comprises the 2' O-methyl modified nucleoside, in a 5' to 3' direction.

517. The method of any one of embodiments 507-516, wherein the eighth nucleoside of the antisense strand comprises the 2' O-methyl modified nucleoside, in a 5' to 3' direction.

518. The method of any one of embodiments 507-517, wherein the ninth nucleoside of the antisense strand comprises the 2' O-methyl modified nucleoside, in a 5' to 3' direction.

519. The method of any one of embodiments 507-518, wherein the tenth nucleoside of the antisense strand comprises the 2' O-methyl modified nucleoside, in a 5' to 3' direction.

520. The method of any one of embodiments 507-519, wherein the eleventh nucleoside of the antisense strand comprises the 2' O-methyl modified nucleoside, in a 5' to 3' direction.

521. The method of any one of embodiments 507-520, wherein the twelfth nucleoside of the antisense strand comprises the 2' O-methyl modified nucleoside, in a 5' to 3' direction.

522. The method of any one of embodiments 507-521, wherein the thirteenth nucleoside of the antisense strand comprises the 2' O-methyl modified nucleoside, in a 5' to 3' direction.

523. The method of any one of embodiments 507-522, wherein the fifteenth nucleoside of the antisense strand comprises the 2' O-methyl modified nucleoside, in a 5' to 3' direction.

524. The method of any one of embodiments 507-523, wherein the seventeenth nucleoside of the antisense strand comprises the 2' O-methyl modified nucleoside, in a 5' to 3' direction.

525. The method of any one of embodiments 507-524, wherein the eighteenth nucleoside of the antisense strand comprises the 2' O-methyl modified nucleoside, in a 5' to 3' direction.

526. The method of any one of embodiments 507-525, wherein the nineteenth nucleoside of the antisense strand comprises the 2' O-methyl modified nucleoside, in a 5' to 3' direction.

527. The method of any one of embodiments 507-526, wherein the twentieth nucleoside of the antisense strand comprises the 2' O-methyl modified nucleoside, in a 5' to 3' direction.

528. The method of any one of embodiments 507-527, wherein the twenty-first nucleoside of the antisense strand comprises the 2' O-methyl modified nucleoside, in a 5' to 3' direction.

529. The method of any one of embodiments 507-528, wherein the first, third, fifth, seventh, eleventh, twelfth, thirteenth, fifteenth, seventeenth, nineteenth, twentieth, and twenty-first nucleosides of the antisense strand comprises the 2' O-methyl modified nucleoside, in a 5' to 3' direction.

530. The method of any one of embodiments 507-529, wherein the antisense strand comprises at least two contiguous 2' O-methyl modified nucleosides.

531. The method of embodiment 530, wherein the at least two contiguous 2' O-methyl modified nucleosides is three contiguous 2' O-methyl modified nucleosides.

532. The method of embodiment 530, wherein the at least two contiguous 2' O-methyl modified nucleosides is four contiguous 2' O-methyl modified nucleosides.

533. The method of embodiment 530, wherein the at least two contiguous 2' O-methyl modified nucleosides is five contiguous 2' O-methyl modified nucleosides.

534. The method of embodiment 530, wherein the at least two contiguous 2' O-methyl modified nucleosides is six contiguous 2' O-methyl modified nucleosides.

535. The method of embodiment 530, wherein the at least two contiguous 2' O-methyl modified nucleosides is seven contiguous 2' O-methyl modified nucleosides.

536. The method of any one of embodiments 507-535, wherein the antisense strand comprises a first sequence comprising at least two contiguous 2' O-methyl modified nucleosides and a second sequence comprising at least two contiguous 2' O-methyl modified nucleosides.

537. The method of embodiment 536, wherein the first sequence comprises at least three contiguous 2' O-methyl modified nucleosides, and the second sequence comprises at least three contiguous 2' O-methyl modified nucleosides.

538. The method of embodiment 536, wherein the first sequence comprises three contiguous 2' O-methyl modified nucleosides, and the second sequence comprises three contiguous 2' O-methyl modified nucleosides.

539. The method of embodiment 536, wherein the first sequence comprises four contiguous 2' O-methyl modified nucleosides, and the second sequence comprises five contiguous 2' O-methyl modified nucleosides.

540. The method of embodiment 536, wherein the first sequence comprises seven contiguous 2' O-methyl modified nucleosides, and the second sequence comprises five contiguous 2' O-methyl modified nucleosides.

541. The method of embodiment 536, wherein the first sequence comprises at least four contiguous 2' O-methyl modified nucleosides.

542. The method of embodiment 536, wherein the first sequence comprises at least five contiguous 2' O-methyl modified nucleosides.

543. The method of embodiment 536, wherein the first sequence comprises at least six contiguous 2' O-methyl modified nucleosides.

544. The method of embodiment 536, wherein the first sequence comprises at least seven contiguous 2' O-methyl modified nucleosides.

545. The method of any one of embodiments 541-544, wherein the second sequence comprises at least four contiguous 2' O-methyl modified nucleosides.

546. The method of any one of embodiments 541-544, wherein the second sequence comprises at least five contiguous 2' O-methyl modified nucleosides.

547. The method of any one of embodiments 511-544, wherein the second sequence comprises at least six contiguous 2' O-methyl modified nucleosides.

548. The method of any one of embodiments 511-544, wherein the second sequence comprises at least seven contiguous 2' O-methyl modified nucleosides.

549. The method of any one of embodiments 368-548, wherein the sense strand comprises a ribose.

550. The method of embodiment 549, wherein the sense strand comprises about 1, 2, 3, 4, 5, 6, 7, 8, 9, 10, 11, 12, 13, 14, 15, 16, 17, 18, 19, 20, or 21 ribose.

551. The method of embodiment 549 or embodiment 550, wherein the first nucleoside of the sense strand comprises the ribose, in a 5' to 3' direction.

552. The method of any one of embodiments 549-551, wherein the second nucleoside of the sense strand comprises the ribose, in a 5' to 3' direction.

553. The method of any one of embodiments 549-552, wherein the third nucleoside of the sense strand comprises the ribose, in a 5' to 3' direction.

554. The method of any one of embodiments 549-553, wherein the fourth nucleoside of the sense strand comprises the ribose, in a 5' to 3' direction.

555. The method of any one of embodiments 549-554, wherein the fifth nucleoside of the sense strand comprises the ribose, in a 5' to 3' direction.

556. The method of any one of embodiments 549-555, wherein the sixth nucleoside of the sense strand comprises the ribose, in a 5' to 3' direction.

557. The method of any one of embodiments 549-556, wherein the seventh nucleoside of the sense strand comprises the ribose, in a 5' to 3' direction.

558. The method of any one of embodiments 549-557, wherein the eighth nucleoside of the sense strand comprises the ribose, in a 5' to 3' direction.

559. The method of any one of embodiments 549-558, wherein the ninth nucleoside of the sense strand comprises the ribose, in a 5' to 3' direction.

560. The method of any one of embodiments 549-559, wherein the tenth nucleoside of the sense strand comprises the ribose, in a 5' to 3' direction.

561. The method of any one of embodiments 549-560, wherein the eleventh nucleoside of the sense strand comprises the ribose, in a 5' to 3' direction.

562. The method of any one of embodiments 549-561, wherein the twelfth nucleoside of the sense strand comprises the ribose, in a 5' to 3' direction.

563. The method of any one of embodiments 549-562, wherein the thirteenth nucleoside of the sense strand comprises the ribose, in a 5' to 3' direction.

564. The method of any one of embodiments 549-563, wherein the fourteenth nucleoside of the sense strand comprises the ribose, in a 5' to 3' direction.

565. The method of any one of embodiments 549-564, wherein the fifteenth nucleoside of the sense strand comprises the ribose, in a 5' to 3' direction.

566. The method of any one of embodiments 549-565, wherein the sixteenth nucleoside of the sense strand comprises the ribose, in a 5' to 3' direction.

567. The method of any one of embodiments 549-566, wherein the seventeenth nucleoside of the sense strand comprises the ribose, in a 5' to 3' direction.

568. The method of any one of embodiments 549-567, wherein the eighteenth nucleoside of the sense strand comprises the ribose, in a 5' to 3' direction.

569. The method of any one of embodiments 549-568, wherein the nineteenth nucleoside of the sense strand comprises the ribose, in a 5' to 3' direction.

570. The method of any one of embodiments 549-569, wherein the twentieth nucleoside of the sense strand comprises the ribose, in a 5' to 3' direction.

571. The method of any one of embodiments 549-570, wherein the twenty-first nucleoside of the sense strand comprises the ribose, in a 5' to 3' direction.

572. The method of any one of embodiments 368-571, wherein the antisense strand comprises a ribose.

573. The method of embodiment 572, wherein the antisense strand comprises about 1, 2, 3, 4, 5, 6, 7, 8, 9, 10, 11, 12, 13, 14, 15, 16, 17, 18, 19, 20, or 21 ribose.

574. The method of embodiment 572 or embodiment 573, wherein the first nucleoside of the antisense strand comprises the ribose, in a 5' to 3' direction.

575. The method of any one of embodiments 572-574, wherein the second nucleoside of the antisense strand comprises the ribose, in a 5' to 3' direction.

576. The method of any one of embodiments 572-575, wherein the third nucleoside of the antisense strand comprises the ribose, in a 5' to 3' direction.

577. The method of any one of embodiments 572-576, wherein the fourth nucleoside of the antisense strand comprises the ribose, in a 5' to 3' direction.

578. The method of any one of embodiments 572-577, wherein the fifth nucleoside of the antisense strand comprises the ribose, in a 5' to 3' direction.

579. The method of any one of embodiments 572-578, wherein the sixth nucleoside of the antisense strand comprises the ribose, in a 5' to 3' direction.

580. The method of any one of embodiments 572-579, wherein the seventh nucleoside of the antisense strand comprises the ribose, in a 5' to 3' direction.

581. The method of any one of embodiments 572-580, wherein the eighth nucleoside of the antisense strand comprises the ribose, in a 5' to 3' direction.

582. The method of any one of embodiments 572-581, wherein the ninth nucleoside of the antisense strand comprises the ribose, in a 5' to 3' direction.

583. The method of any one of embodiments 572-582, wherein the tenth nucleoside of the sense antisense comprises the ribose, in a 5' to 3' direction.

584. The method of any one of embodiments 572-583, wherein the eleventh nucleoside of the antisense strand comprises the ribose, in a 5' to 3' direction.

585. The method of any one of embodiments 572-584, wherein the twelfth nucleoside of the antisense strand comprises the ribose, in a 5' to 3' direction.

586. The method of any one of embodiments 572-585, wherein the thirteenth nucleoside of the antisense strand comprises the ribose, in a 5' to 3' direction.

587. The method of any one of embodiments 572-586, wherein the fourteenth nucleoside of the antisense strand comprises the ribose, in a 5' to 3' direction.

588. The method of any one of embodiments 572-587, wherein the fifteenth nucleoside of the antisense strand comprises the ribose, in a 5' to 3' direction.

589. The method of any one of embodiments 572-588, wherein the sixteenth nucleoside of the antisense strand comprises the ribose, in a 5' to 3' direction.

590. The method of any one of embodiments 572-589, wherein the seventeenth nucleoside of the antisense strand comprises the ribose, in a 5' to 3' direction.

591. The method of any one of embodiments 572-590, wherein the eighteenth nucleoside of the antisense strand comprises the ribose, in a 5' to 3' direction.

592. The method of any one of embodiments 572-591, wherein the nineteenth nucleoside of the antisense strand comprises the ribose, in a 5' to 3' direction.

593. The method of any one of embodiments 572-592, wherein the twentieth nucleoside of the antisense strand comprises the ribose, in a 5' to 3' direction.

594. The method of any one of embodiments 572-593, wherein the twenty-first nucleoside of the antisense strand comprises the ribose, in a 5' to 3' direction.

595. The method of any one of embodiments 368-594, further comprising a lipid attached at either 3' or 5' terminus.

596. The method of embodiment 595, wherein the lipid comprises cholesterol, myristoyl, palmitoyl, stearoyl, lithocholoyl, docosanoyl, docosahexaenoyl, myristyl, palmityl stearyl, α-tocopherol, or a combination thereof.

597. The method of embodiment 595 or embodiment 596, wherein the lipid comprises a first lipid on the sense strand and a second lipid on the antisense strand.

598. The method of any one of embodiments 595-597, wherein the lipid is positioned on the sense strand.

599. The method of embodiment 598, wherein the lipid is positioned at the 5' end of the sense strand.

600. The method of embodiment 598, wherein the lipid is positioned at the 3' end of the sense strand.

601. The method of any one of embodiments 595-600, wherein the lipid is positioned on the antisense strand.

602. The method of embodiment 601, wherein the lipid is positioned at the 5' end of the antisense strand.

603. The method of embodiment 601, wherein the lipid is positioned at the 3' end of the antisense strand.

604. The method of any one of embodiments 368-594, further comprising an arginine-glycine-aspartic acid (RGD) ligand attached at a 3' terminus and/or a 5' terminus.

605. The method of any one of embodiments 368-603, further comprising an RGD ligand attached at either a 3' terminus or a 5' terminus.

606. The method of embodiment 604 or 605, wherein the RGD ligand comprises Cyclo(-Arg-Gly-Asp-D-Phe-Cys), Cyclo(-Arg-Gly-Asp-D-Phe-Lys), Cyclo(-Arg-Gly-Asp-D-Phe-azido), Cyclo(-Arg-Gly-Asp-D-Phe-alkynyl), amino benzoic acid-based RGD, or a combination thereof.

607. The method of embodiment 604 or embodiment 605, wherein the RGD ligand is composed of 2, 3 or 4 RGD ligands.

608. The method of any one of embodiments 604-607, wherein the RGD is positioned on the sense strand.

609. The method of embodiment 608, wherein the RGD is positioned at the 5' end of the sense strand.

610. The method of embodiment 608, wherein the RGD is positioned at the 3' end of the sense strand.

611. The method of any one of embodiments 604-607, wherein the RGD is positioned on the antisense strand.

612. The method of embodiment 611, wherein the RGD ligand is positioned at the 5' end of the antisense strand.

613. The method of embodiment 611, wherein the RGD ligand is positioned at the 3' end of the antisense strand.

614. The method of any one of embodiments 368-613, wherein the sense strand and the antisense strand form a double-stranded RNA duplex.

615. The method of embodiment 614, wherein the double-stranded RNA duplex comprises from about 14 to about 30 nucleosides.

616. The method of embodiment 614, wherein the double-stranded RNA duplex comprises from about 17 to about 30 nucleosides.

617. The method of embodiment 614, wherein the double-stranded RNA duplex comprises about 21 nucleosides.

618. The method of any one of embodiments 614-617, wherein the double-stranded RNA duplex comprises at least one base pair.

619. The method of embodiment 618, wherein the first base pair of the double-stranded RNA duplex is an AU base pair.

620. The method of any one of embodiments 368-614, wherein the sense strand comprises pattern 1S: 5' fN s mN s fN-mN-fN-mN-fN-fN-fN-mN-fN-mN-fN-mN-fN-mN-fN-mN-fN s mN s mN 3' (SEQ ID NO: 11381), wherein "fN" is a 2' fluoro-modified nucleoside, "mN" is a 2' O-methyl modified nucleoside, "-" is a phosphodiester, and "s" is a phosphorothioate.

621. The method of any one of embodiments 368-614, wherein the sense strand comprises pattern 2S: 5' mN s mN s mN-mN-fN-mN-fN-fN-fN-mN-mN-mN-mN-mN-mN-mN-mN-mN-mN s mN s mN 3' (SEQ ID NO: 11382), wherein "fN" is a 2' fluoro-modified nucleoside, "mN" is a 2' O-methyl modified nucleoside, "-" is a phosphodiester, and "s" is a phosphorothioate.

622. The method of any one of embodiments 368-614, wherein the sense strand comprises pattern 3S: 5' mN s mN s mN-mN-fN-mN-fN-mN-fN-mN-mN-mN-mN-mN-mN-mN-mN-mN-mN s mN s mN 3' (SEQ ID NO: 11383), wherein "fN" is a 2' fluoro-modified nucleoside, "mN" is a 2' O-methyl modified nucleoside, "-" is a phosphodiester, and "s" is a phosphorothioate.

623. The method of any one of embodiments 368-614, wherein the sense strand comprises pattern 4S: 5' fN s mN s fN-mN-fN-mN-fN-fN-fN-mN-fN-mN-fN-mN-fN-mN-fN-mN-fN s mN s mN-N-Lipid 3' (SEQ ID NO: 11384), wherein "fN" is a 2' fluoro-modified nucleoside, "mN" is a 2' O-methyl modified nucleoside, "-" is a phosphodiester, "s" is a phosphorothioate, and N comprises one or more nucleosides.

624. The method of embodiment 623, wherein the one or more nucleosides is three nucleosides.

625. The method of embodiment 623 or 624, wherein each of the one or more nucleosides independently comprise a ribose or deoxyribose.

626. The method of any one of embodiments 368-619, wherein the sense strand comprises pattern 5S: 5' mN s mN s mN-mN-fN-mN-fN-fN-fN-mN-mN-mN-mN-mN-mN-mN-mN-mN-mN s mN s mN-N-Lipid 3' (SEQ ID NO: 11385), wherein "fN" is a 2' fluoro-modified nucleoside, "mN" is a 2' O-methyl modified nucleoside, "-" is a phosphodiester, "s" is a phosphorothioate, and N comprises one or more nucleosides.

627. The method of embodiment 626, wherein the one or more nucleosides is three nucleosides.

628. The method of embodiment 626 or 627, wherein each of the one or more nucleosides independently comprise a ribose or deoxyribose.

629. The method of any one of embodiments 368-628, wherein the antisense strand comprises pattern 1AS: 5' mN s fN s mN-fN-mN-fN-mN-fN-mN-fN-mN-mN-mN-fN-mN-fN-mN-fN-mN s mN s mN 3' (SEQ ID NO: 11386), wherein "fN" is a 2' fluoro-modified nucleoside, "mN" is a 2' O-methyl modified nucleoside, "-" is a phosphodiester, and "s" is a phosphorothioate.

630. The method of any one of embodiments 368-628, wherein the antisense strand comprises pattern 2AS: 5' mN s fN s mN-mN-mN-fN-mN-fN-fN-mN-mN-mN-mN-fN-mN-fN-mN-mN-mN s mN s mN 3' (SEQ ID NO: 11387), wherein "fN" is a 2' fluoro-modified nucleoside, "mN" is a 2' O-methyl modified nucleoside, "-" is a phosphodiester, and "s" is a phosphorothioate.

631. The method of any one of embodiments 368-628, wherein the antisense strand comprises pattern 3AS: 5' mN s fN s mN-mN-mN-fN-mN-mN-mN-mN-mN-mN-mN-fN-mN-fN-mN-mN-mN s mN s mN 3' (SEQ ID NO: 11388), wherein "fN" is a 2' fluoro-modified nucleoside, "mN" is a 2' O-methyl modified nucleoside, "-" is a phosphodiester, and "s" is a phosphorothioate.

632. The method of any one of embodiments 368-628, wherein the antisense strand comprises pattern 4AS: 5' mN s fN s mN-fN-mN-fN-mN-mN-mN-mN-mN-mN-mN-fN-mN-fN-mN-mN-mN s mN s mN 3' (SEQ ID NO: 11389), wherein "fN" is a 2' fluoro-modified nucleoside, "mN" is a 2' O-methyl modified nucleoside, "-" is a phosphodiester, and "s" is a phosphorothioate.

633. The method of any one of embodiments 368-619, wherein the sense strand comprises pattern 1 S and the antisense strand comprises pattern 1AS.

634. The method of any one of embodiments 368-619, wherein the sense strand comprises pattern 2S and the antisense strand comprises pattern 2AS.

635. The method of any one of embodiments 368-619, wherein the sense strand comprises pattern 3S and the antisense strand comprises pattern 3AS.

636. The method of any one of embodiments 368-619, wherein the sense strand comprises pattern 4S and the antisense strand comprises pattern 4AS.

EXAMPLES

The following non-limiting examples serve to illustrate selected embodiments. It will be appreciated that variations in proportions and alternatives in elements of the components shown will be apparent to those skilled in the art and are within the scope of embodiments presented herein.

Example 1. Association of ANGPTL7 Protein Altering Variants with IOP and Glaucoma Applicant evaluated approximately 30,000,000 imputed variants in ~350,000 individuals from the UK Biobank cohort for associations with glaucoma and glaucoma-relevant phenotypes, including non-specific glaucoma, primary open angle glaucoma (POAG), primary angle closure glaucoma (PACG), glaucoma surgery, glaucoma medication use, and intraocular pressure (IOP) (see Table 1). Elevated IOP is a primary causal feature and risk factor for glaucoma.

TABLE 1

Case Definitions and Case and Control Counts for Evaluated Phenotypes

| Trait | Case Definition | Case # | Control # |
|---|---|---|---|
| Glaucoma | Hospital diagnosis of glaucoma OR glaucoma surgery or meds OR self-reported history of glaucoma in a nurse-led interview | 6896 | 328209 |
| ICD Glaucoma POAG | Hospital diagnosis of primary open angle glaucoma | 836 | 328209 |
| ICD Glaucoma PACG | Hospital diagnosis of primary angle closed glaucoma | 571 | 328209 |
| Glaucoma Surgery | Hospital procedure for glaucoma | 1229 | 328209 |
| Glaucoma Medication | Use of prostaglandin analogs, alpha agonists, carbonic anhydrase inhibitors, and beta blockers used to treat glaucoma | 2131 | 328209 |
| IOP | intra-ocular pressure measure | 70107 | NA |

Associations were observed between a rare missense variant (rs28991009; minor allele frequency ~0.0073) within ANGPTL7 and glaucoma and related traits (see Table 2). The major allele of this variant (chr1-11253684-G, hg19) encodes for a glutamine and the minor allele (chr1-11253684-T, hg19) a histidine at amino acid position 175 of the full length ANGPTL7 protein (Gln175His; Q175H). Carriers of the minor allele of this variant had about half the risk of glaucoma as non-carriers (p=4×10^-5; OR=0.61). ICD defined subtypes of POAG (p=0.04; OR=0.0.44) and PACG (p=0.08; OR=0.42) demonstrated similar protection. Odds of glaucoma medication use (p=0.04; OR=0.66) and glaucoma surgery (p=0.03; OR=0.50) were also reduced, and an association with reduced IOP was observed (p=2×10^-13; beta=-0.21).

TABLE 2

Association of ANGPTL7 Variant rs28991009 with Glaucoma and Related Traits

| Trait | Variant | Effect Size | P |
|---|---|---|---|
| Glaucoma | rs28991009 | 0.61 (OR) | 4.07E-05 |
| ICD Glaucoma POAG | rs28991009 | 0.44 (OR) | 0.04 |
| ICD Glaucoma PACG | rs28991009 | 0.42 (OR) | 0.08 |

TABLE 2-continued

Association of ANGPTL7 Variant rs28991009 with Glaucoma and Related Traits

| Trait | Variant | Effect Size | P |
|---|---|---|---|
| Glaucoma Surgery | rs28991009 | 0.50 (OR) | 0.03 |
| Glaucoma Medication | rs28991009 | 0.66 (OR) | 0.04 |
| IOP | rs28991009 | −0.21 (Beta) | 1.95E−13 |

Next, we performed a gene burden test utilizing all protein altering variants in ANGPTL7. Gene burden tests are used to aggregate rare variants in a gene by functional class that are too rare to be tested individually. Though imputation of array genotypes has improved significantly with the availability of large reference datasets consisting of haplotypes observed in whole genome sequencing studies, imputation of very rare variants remains challenging and can be inaccurate. For this reason, we conducted the burden test using all directly genotyped protein altering variants in ANGPTL7, resulting in inclusion of the Q175H missense variant (MAF=0.0073; rs28991009), an R140H missense variant (MAF=0.0024; rs28991002), a G136R missense variant (MAF=0.0005; rs200058074) and an R177Ter stop gain variant (MAF=0.0004; rs143435072). Individuals carrying predicted ANGPTL7 protein altering variants had a significantly lower IOP when compared to non-carriers (p=1.01E-17; beta=−0.20) (Table 3). The burden result was driven by the Q175H, R140H and R177Ter variants; the G136R variant was not associated with IOP (Table 3).

TABLE 3

Association of ANGPTL7 Protein Altering Variants with IOP

| RSID | Function | AAF | REF | ALT | BETA (95% CI) | P |
|---|---|---|---|---|---|---|
| rs28991009 | Missense (Q175H) | 7.27E−03 | G | T | −0.22 (−0.27, −0.16) | 2.72E−14 |
| rs28991002 | Missense (R140H) | 2.36E−03 | G | A | −0.17 (−0.27, −0.08) | 4.63E−04 |
| rs143435072 | Stop gain (R177Ter) | 3.81E−04 | C | T | −0.39 (−0.64, −0.14) | 2.00E−03 |
| rs200058074 | Missense (G136R) | 5.06E−04 | A | G | 0.02 (−0.19, 0.24) | 0.84 |
| Burden | NA | 1.05E−02 | NA | NA | −0.20 (−0.25, −0.15) | 1.01E−17 |

The protective (i.e. IOP-lowering) associations with Q175H and R140H were directionally consistent with the predicted loss of function variant R177Ter; in other words, the minor allele of all three variants was associated with decreased IOP. By inference, these data indicate that loss of function (LOF) of ANGPTL7 protects against the development of ocular hypertension and glaucoma. Accordingly, in some cases therapeutic inhibition or modulation of ANGPTL7 may be an effective genetically-informed method of treatment for these diseases.

Example 2: Protective (i.e. IOP-Lowering) Variants in ANGPTL7 Result in Less Secreted ANGPTL7 Protein Pre-mRNA or protein-coding sequence (CDS) expression constructs encoding for wild type, Q175H. R140H and R177Ter proteins were generated (FIG. 1). The pre-mRNA or CDS of the protein coding transcript (ENST00000376819) of ANGPTL7 was cloned into a pcDNA3.1(+) vector driven by a CMV promoter. Note that the pre-mRNA constructs contained exons, introns, and 5' and 3' UTRs, while the CDS constructs contained only exons. The purpose in utilizing pre-mRNA constructs is that they allow for evaluation of alternatively spliced transcripts.

Empty vector and a GFP tagged vector were used as controls. For Q175H(rs28991009) expression constructs, the T allele replaces the G allele at DNA sequence position chr1:11253684 (human genome build 37). This creates a Gln175His amino acid substitution in the ANGPTL7 protein. For R140H (rs28991002) expression constructs, the A allele replaces the G allele at DNA position chr1:11252369 (human genome build 37). For R177Ter (rs143435072) expression constructs, the T allele replaces the C allele at DNA sequence position chr1:11253688 (human genome build 37). This creates an Arg177Ter premature stop codon.

Figure 2:
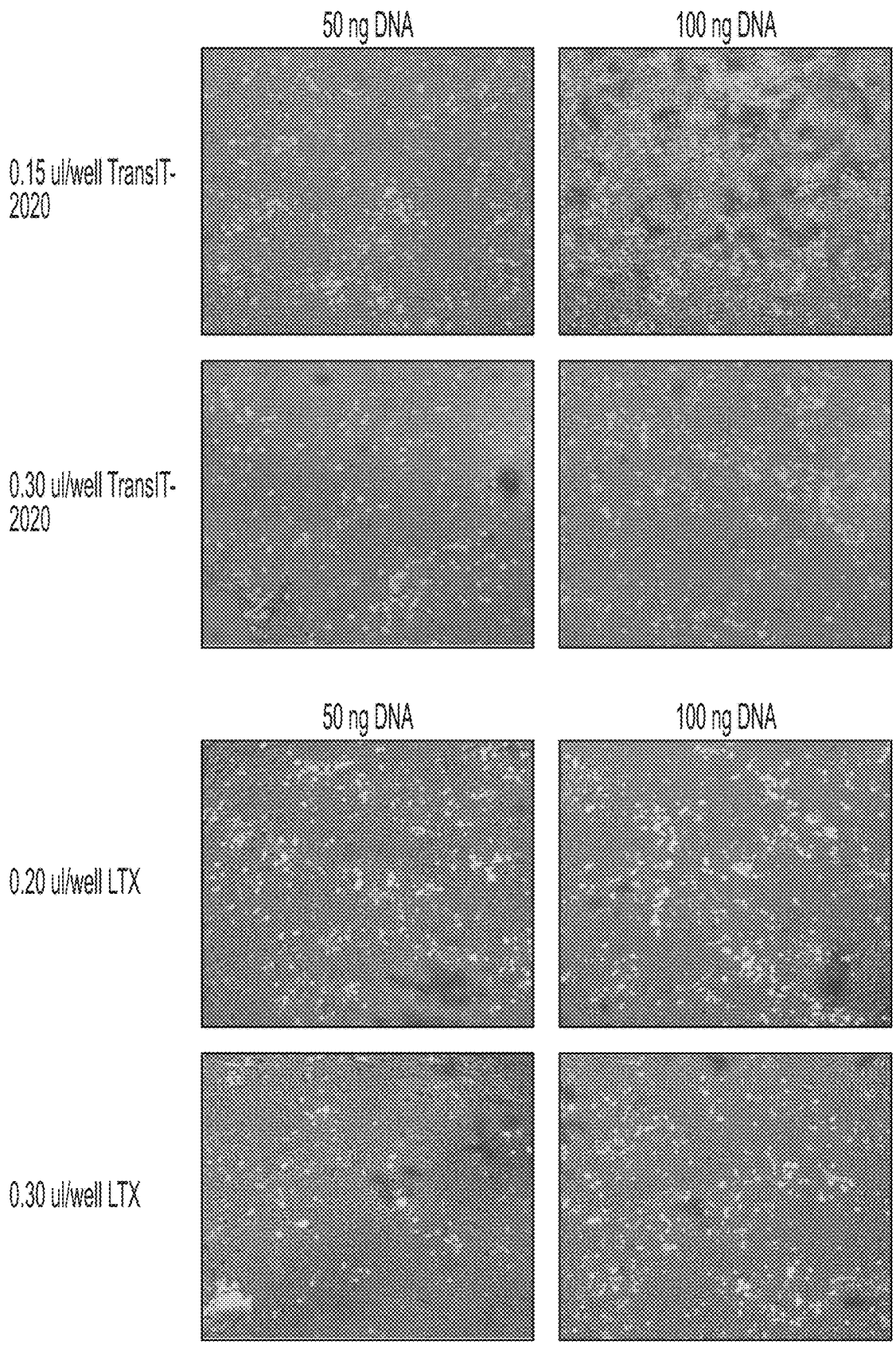
FIG. 2 shows fluorescent microscopy images of HEK293 cells transfected with a pcDNA3.1(+) GFP vector.
Figure 3:
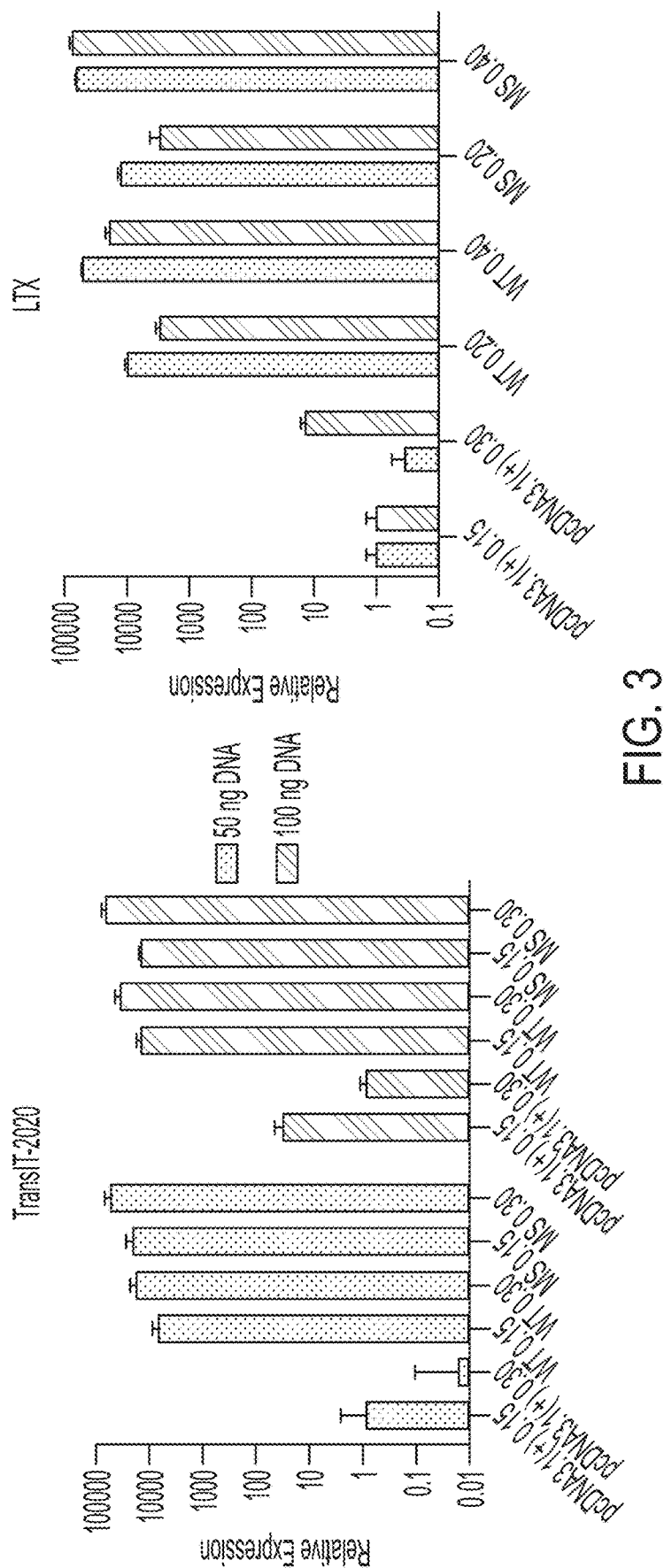
FIG. 3 shows results of qPCR measuring ANGPTL7 mRNA expression in HEK293 cells transfected with the WT and Q175H pre-mRNA expression constructs.

Transfections of HEK293 cells were optimized using the GFP-tagged and ANGPTL7 WT and Q175H pre-mRNA constructs. Briefly, HEK293 cells were plated at 10,000 cells/well in a 96-well plate in complete growth media and grown for 48 hours followed by a media change. Cells were then transfected with 50 ng or 100 ng of plasmid DNA and 0.15 ul/well or 0.30 ul/well of TransIT-2020 or 0.20 ul/well or 0.40 ul/well Lipofectamine LTX reagents. Cells were incubated for 60 hours, and then either imaged for GFP fluorescence (see FIG. 2) or harvested with Cells-to-Ct reagent and qPCR used to assess ANGPTL7 expression (see FIG. 3). The GFP vector transfection confirmed high transfection efficiency with TransIT-2020 reagent and the qPCR assay confirmed that both the wild-type and Q175H constructs produce ANGPTL7.

Figure 4:
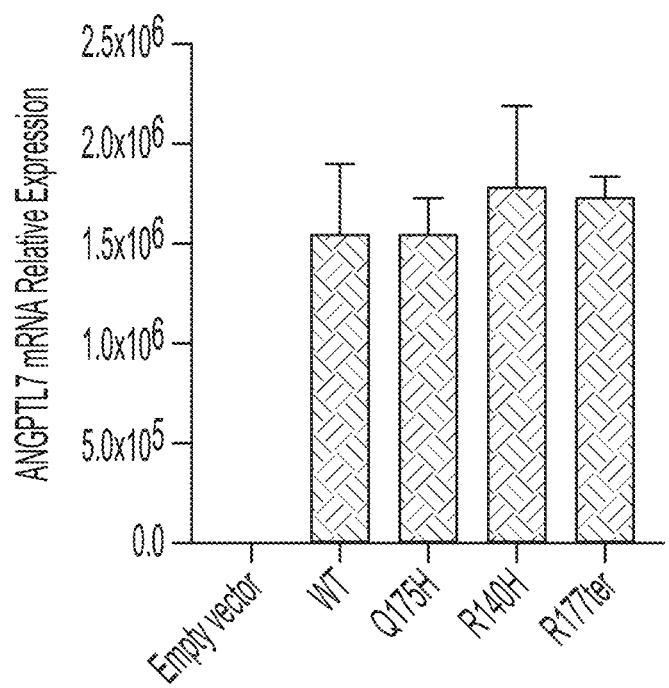
FIG. 4 shows results of qPCR measuring ANGPTL7 mRNA expression in HEK293 cells transfected with the WT, Q175H, R140H and R177Ter pre-mRNA expression constructs.

To evaluate, in parallel, the effects of the Q175H, R140H and R177Ter IOP-lowering variants on mRNA and protein expression levels, wild-type and variant constructs were transiently transfected and expressed in HEK293 cells. ANGPTL7 mRNA expression in empty vector transfected HEK293 cells was negligible, while expression from the plasmid constructs was robust and equivalent between the wild-type and variant (Q175H, R140H and R177Ter) transfected cells (FIG. 4).

Figure 5:
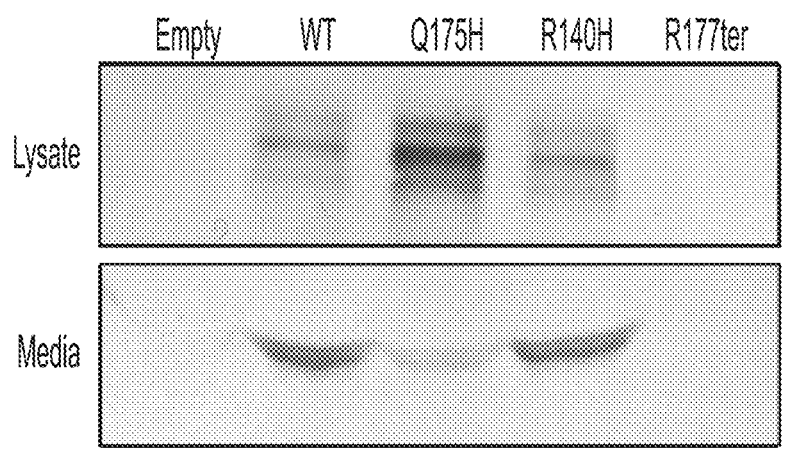
FIG. 5 includes an image of a western blot of ANGPTL7 in HEK293 cells transfected with the WT, Q1751-1, R140H and R177Ter pre-mRNA expression constructs.

Cell lysates and media from transfected cells were assayed to evaluate intracellular and secreted ANGPTL7 protein by Western blot (FIG. 5). In empty vector transfected HEK293 cells, ANGPTL7 was not detectable by Western blot. In cells transfected with the Q175H construct, ANGPTL7 was markedly reduced in the medium and increased in the cell lysate, suggesting a secretion defect. No protein was detected in lysates or media from cells transfected with the R177Ter construct, in spite of mRNA levels that are equivalent to wild type, suggesting degradation at the protein level rather than nonsense mediated decay. There was no apparent difference between wild type and R140H in either secreted or intracellular protein abundance by Western blot.

Figure 6:
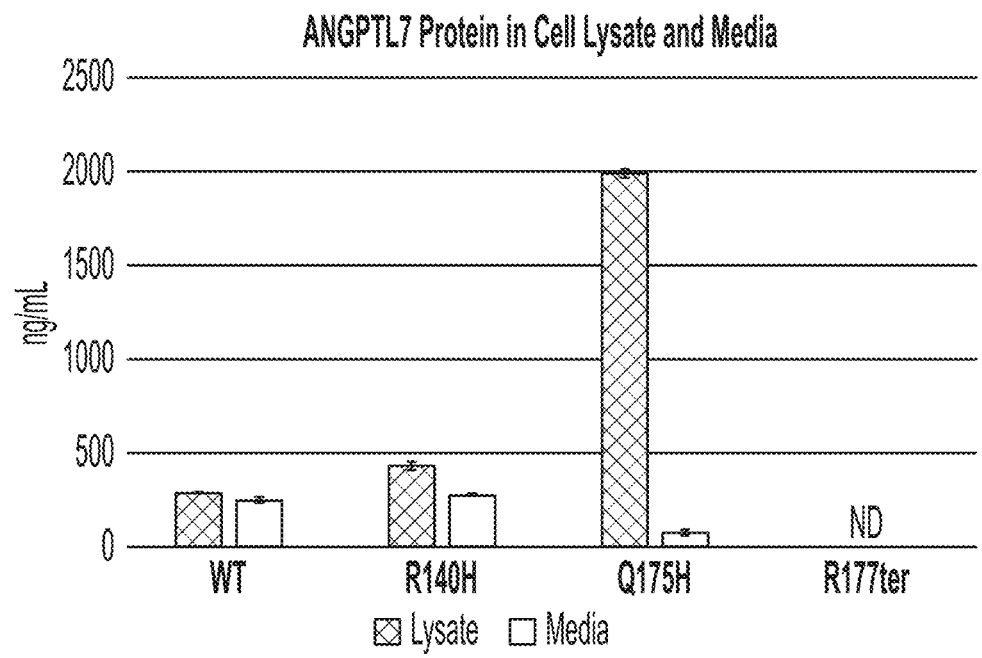
FIG. 6 includes results of an ELISA assay measuring ANGPTL7 protein expression in HEK293 cells transfected with the WT, Q1751-1, R140H and R177Ter pre-mRNA expression constructs.
Figure 7:
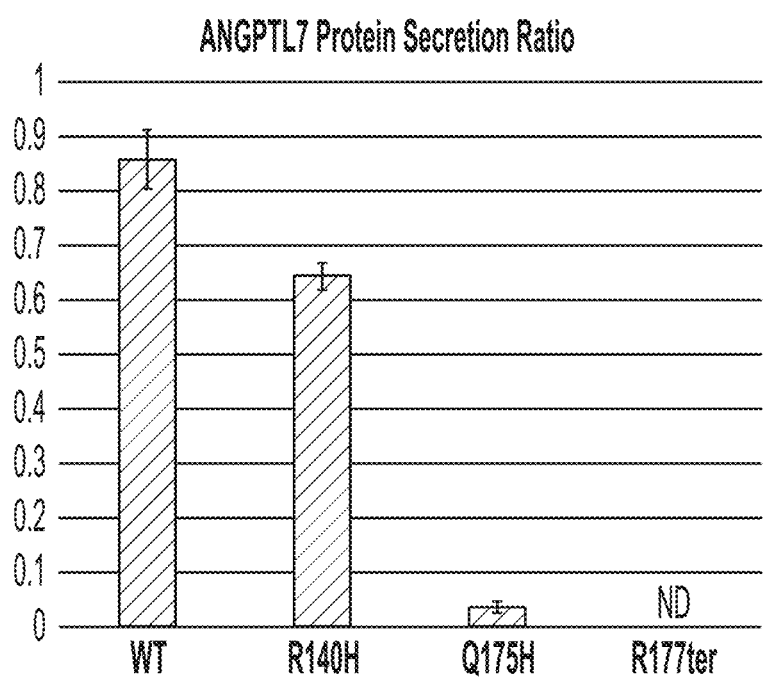
FIG. 7 shows the ratio of secreted vs. intracellular protein (as measured by ELISA) in HEK293 cells transfected with the WT, Q1751-1, R140H and R177Ter pre-mRNA expression constructs.

Western blot results were validated using a quantitative ELISA assay (FIG. 6). Q175H protein was 6.8-fold more abundant in the cell lysate compared to wild-type, whereas the wild-type protein was 3.3-fold more abundant in the media. This results in a heavily skewed ratio of protein in the media versus lysate when comparing wild-type and Q175H missense protein (~22:1 ratio) (FIG. 7). The R140H protein demonstrated a lower secretion ratio than wild type, though this difference was modest. Protein was below the ELISA limit of detection in both the media and cell lysate for cells transfected with the R177Ter construct, consistent with the Western blot results.

Figure 8:
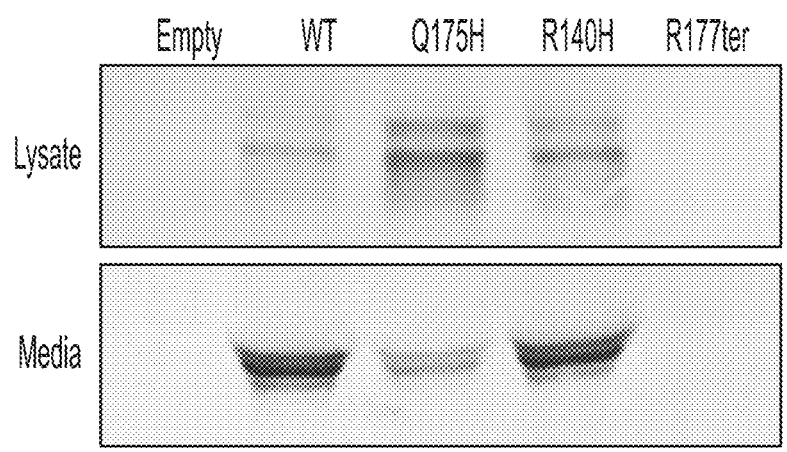
FIG. 8 includes an image of a western blot of ANGPTL7 in HEK293 cells transfected with the WT, Q175H, R140H and R177Ter CDS expression constructs.

Similar experiments were performed using CDS constructs rather than pre-mRNA constructs, and results were equivalent to those for the pre-mRNA constructs, as demonstrated by Western Blot (FIG. 8).

Figure 10:
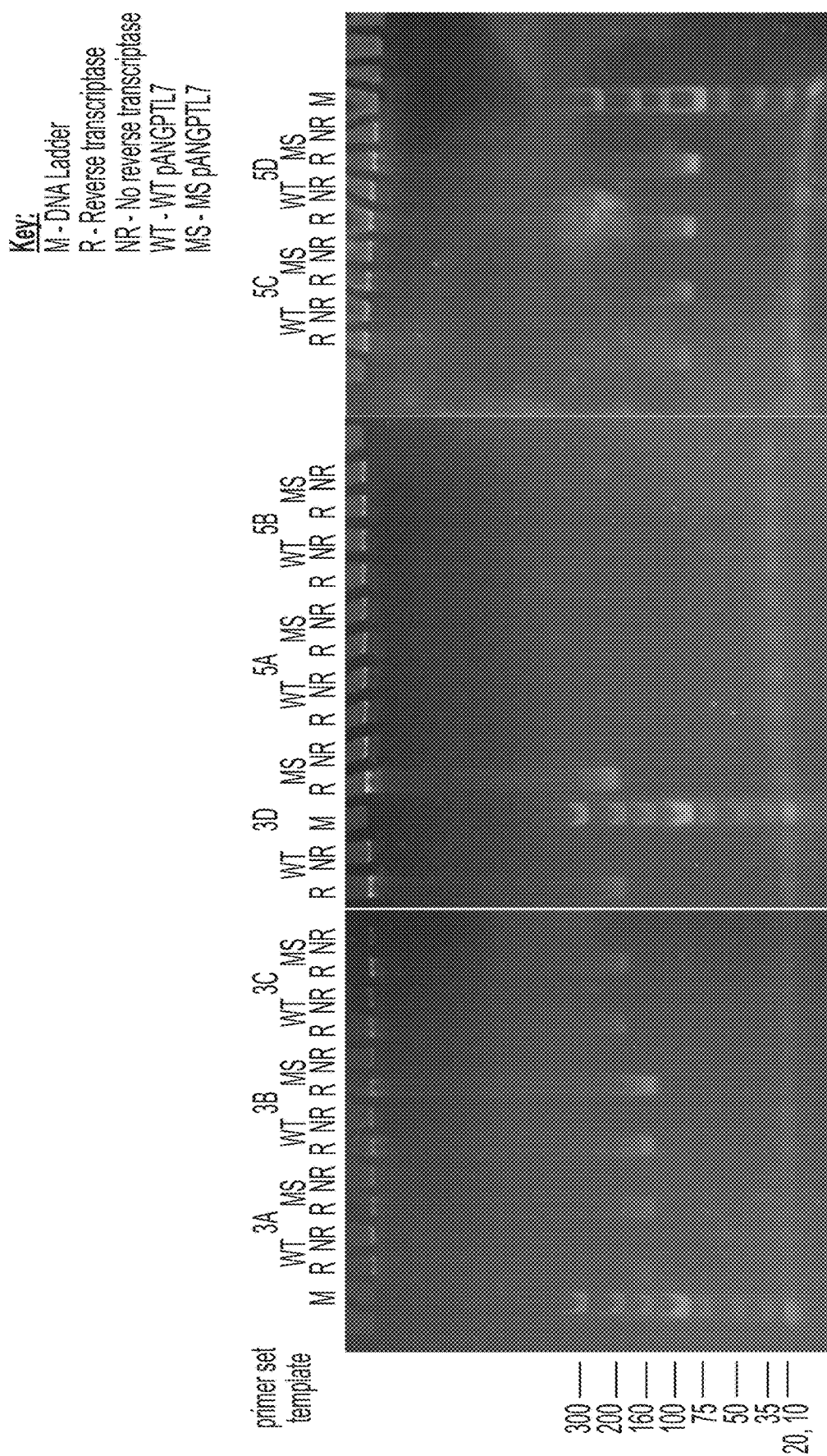
FIG. 10 shows an agarose gel with transcript-specific PCR products from HEK293 cells transfected with WT and Q175H pre-mRNA expression constructs.

Briefly, HEK293 cells were transfected with 50 ng of the wild type or 50 ng of the Q175H pre-mRNA constructs. cDNA was prepared from these transfected cells and was used as template material in a 32-cycle PCR reaction whose products were then run on an agarose gel. The expected amplicon lengths from the various PCR primer combinations are given in Table 4. Both WT and alternatively spliced ANGPTL7 transcripts were produced from both the WT and Q175HANGPTL7 pre-mRNA constructs in transfected HEK-293 cells (FIG. 10). Note that the relative abundance of these transcripts cannot be determined from this PCR assay.

TABLE 4

Primers Sets and Expected Amplicons for Detection of the Protein Coding (WT) and Noncoding (Trunc) Transcripts

| Primer Set | Splice Form | WT mRNA | WT pre-mRNA | Truncated mRNA | Truncated pre-mRNA |
|---|---|---|---|---|---|
| Set 3B (ET P00011/26) | Trunc | 2 MM at 3' 26 | 2 MM at 3' 26 | 142 bp | 3 MM at 3' 26 |
| Set 3C (ET P00011/27) | WT | 208 bp | 894 bp | 2 MM at 3' 27 | 3 MM at 3' 27 |
| Set 3D (ET P00011/28) | WT | 209 bp | 895 bp | 2 MM at 3' 28 | 3 MM at 3' 28 |
| Set 5A (ET P00015/25) | Trunc | 2 MM at 3' 25 | 2 MM at 3' 25, 1 MM 15 | 2 MM at 3' 15 | 3 MM at 3' 25, 1 MM 15 |
| Set 5B (ET P00015/26) | Trunc | 2 MM at 3' 26 | 2 MM at 3' 26, 1 MM 15 | 2 MM at 3' 15 | 3 MM at 3' 26, 1 MM 15 |
| Set 5C (ET P00015/27) | WT | 97 bp | 1 MM at 3' 15 | 2 MM at 3' 27, 15 | 3 MM at 3' 27, 1 MM 15 |
| Set 5D (ET P00015/28) | WT | 98 bp | 1 MM at 3' 15 | 2 MM at 3' 28, 15 | 3 MM at 3' 28, 1 MM 15 |

Therefore, experimental evaluation of ANGPTL7 proteins demonstrates that genetic variants in ANGPTL7 that are observed to lower IOP and protect from ocular hypertension and glaucoma result in reduced intracellular and/or extracellular ANGPTL7 protein, thereby confirming utility of inhibiting or modulating ANGPTL7 for treatment of these diseases.

Example 3: Verification of a Predicted Noncoding ANGPTL7 Transcript

Figure 9:
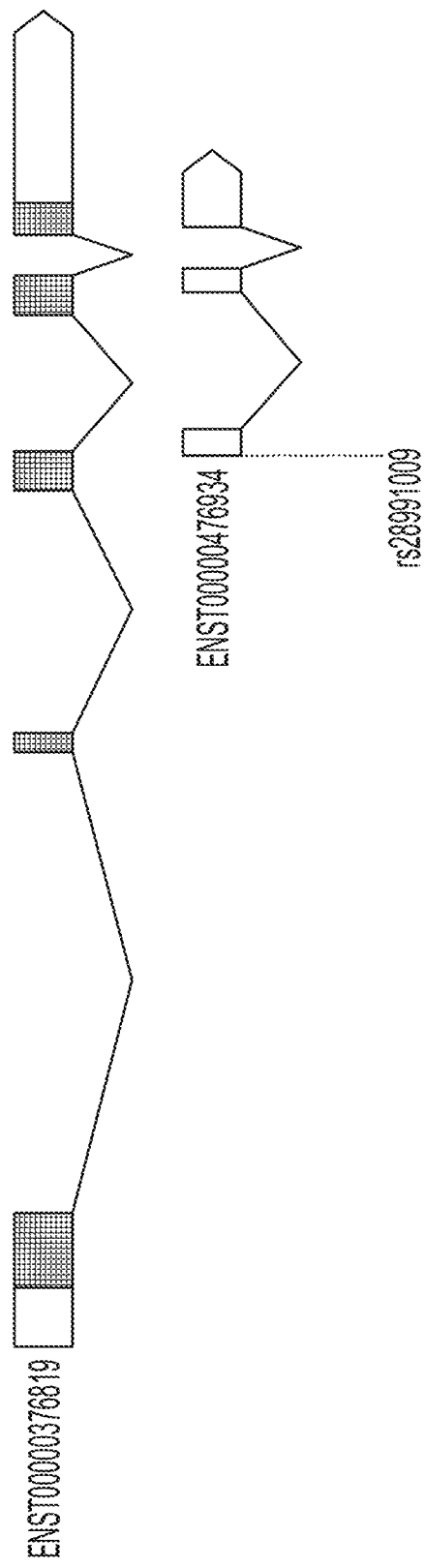
FIG. 9 shows protein coding and noncoding ANGPTL7 transcripts and the relative location of the Q175H missense variant.

ANGPTL7 has two database annotated RNA transcripts, the canonical protein coding transcript (ENST00000376819) and a noncoding transcript (ENST00000476934) (FIG. 9). The protein coding transcript is comprised of five exons encoding for a 346aa protein. The noncoding transcript is comprised of three noncoding exons, the first of which starts within the third exon of the protein coding transcript. The noncoding transcript is a less well annotated transcript with weak support in the Ensembl database. Of note, the rs28991009 (Q175H) variant is located at the first nucleotide position of the noncoding transcript. This suggests possible involvement of this variant in the generation of the noncoding transcript and another possible mechanism, in addition to the secretion defect discovered by the applicant, by which the Q175H missense variant or other variants could result in loss of functional protein.

A number of PCR primers were designed to detect, in a non-quantitative PCR assay, the protein coding and noncoding ANGPTL7 transcripts from HEK293 cells transfected with the wild type and Q175H variant pre-mRNA constructs. These pre-mRNA constructs allow for generation of alternatively spliced transcripts, if such transcripts exist.

Figure 11:
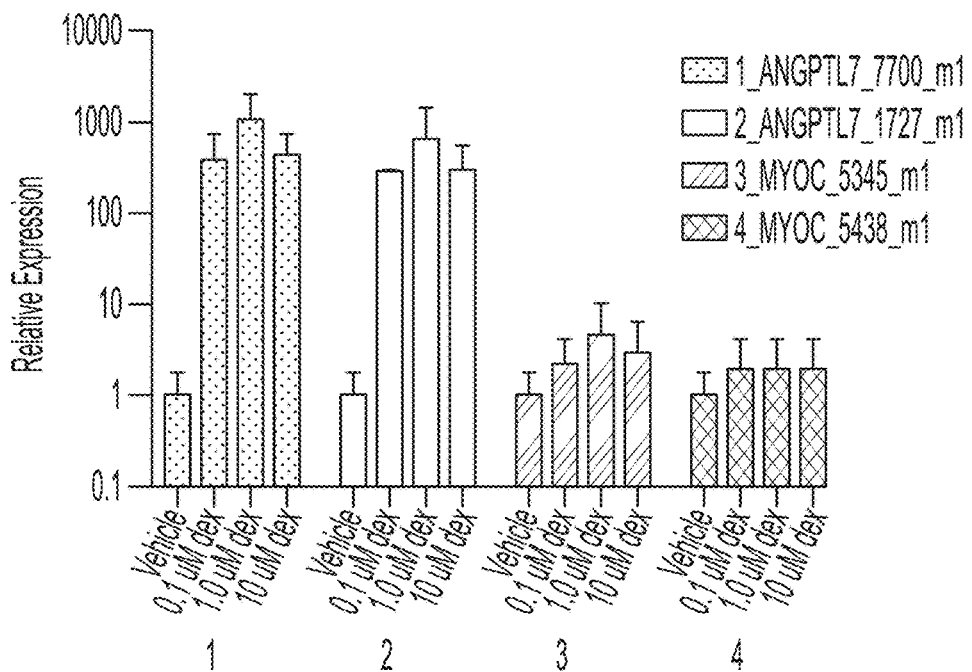
FIG. 11 shows ANGPTL7 and MYOC expression in dexamethasone induced HTM cells.
Figure 12:
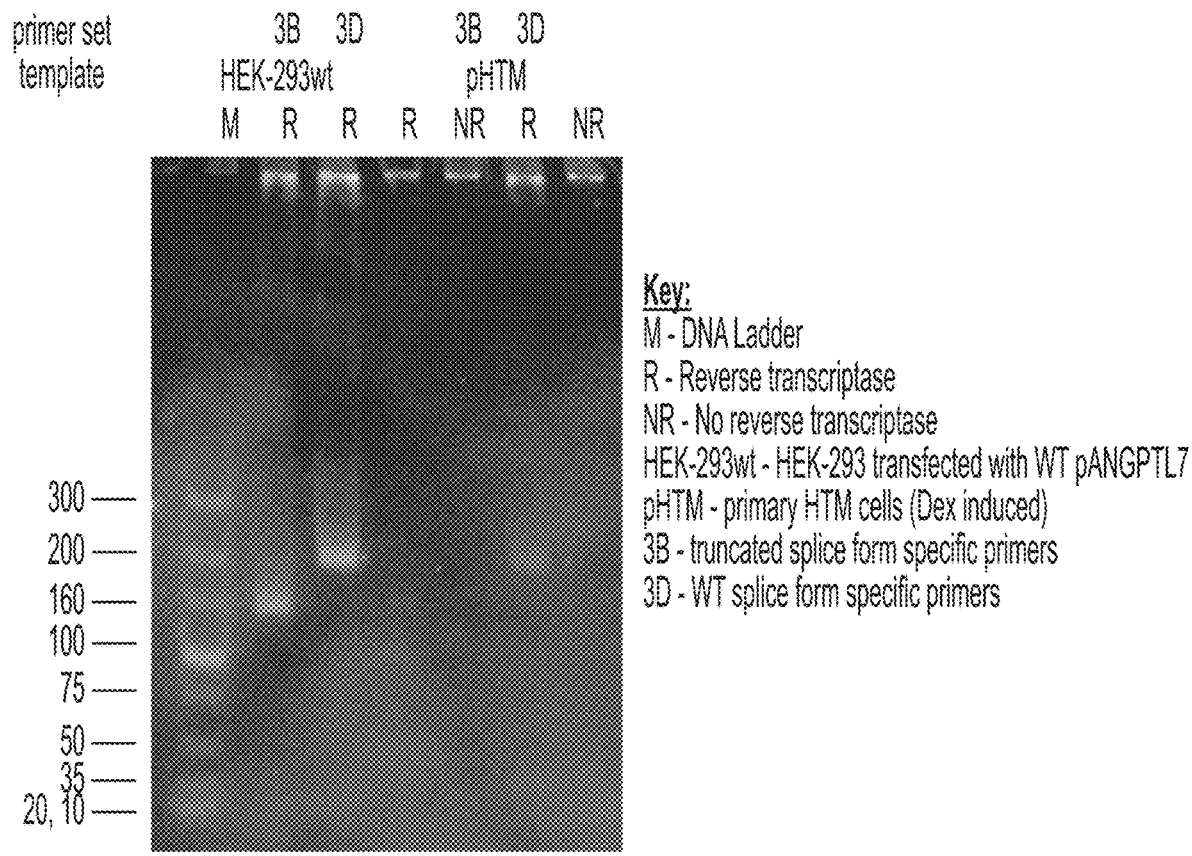
FIG. 12 shows an agarose gel with transcript-specific PCR products from dexamethasone induced primary HTM cells.

Next, primary human trabecular meshwork (HTM) cells were plated at 25,000 cells/well in 24-well plates in complete HTM growth medium and grown overnight. Cells were treated with dexamethasone or vehicle (100% EtOH) for 5 days, then cDNA was harvested with Cells-to-Ct kit and assayed by qPCR with probes for ANGPTL7 and MYOC (FIG. 11). Strong induction of ANGPTL7 and MYOC was observed. Next, cDNA from dexamethasone induced pHTM cells was used as a template in transcript specific PCR reactions using a subset of the primers used above (Table 4). PCR products indicate that the protein coding transcript is present in dexamethasone induced pHTM cells, and that the noncoding or alternatively spliced transcript form is also likely present (but near the limit of detection) using this assay (see FIG. 12).

Therefore, evaluation of native transcripts in pHTM cells as well as evaluation of transcripts arising from pre-mRNA plasmid constructs transfected in HEK293 cells have demonstrated the existence of alternatively spliced ANGPTL7 transcripts consistent with the existence of the putative ANGPLT7 noncoding transcript and suggests a potential mechanism of disease risk modulation.

Example 4: Using CRISPR Knock-Ins to Determine that Protein Altering Variants in ANGPTL7 Alter Transcript and/or Protein Abundance ANGPTL7 CRISPR knock-ins are created for the rs28991009 (Q175I-), rs28991002 (R140I-) and rs143435072 (R177Ter) variants in immortalized human trabecular meshwork cells (iHTMs). For rs28991009 knock-in creation, the T allele replaces the G allele at position chr1:11253684 (human genome build 37). This creates a Gln175His amino acid substitution in the ANGPTL7 protein. For rs28991002 knock-in creation, the A allele replaces the G allele at position chr1:11252369 (human genome build 37). For rs143435072 knock-in creation, the T allele replaces the C allele at position chr1:11253688 (human genome build 37). This creates an Arg177Ter premature stop codon.

Knock-in and wild type iHTM cells are used to demonstrate that the protein altering variants in ANGPTL7 result in secretion defects, or alterations in coding and/or noncoding transcript abundance, or alterations in protein abundance, thereby resulting in loss of functional ANGPTL7 protein. Knock-in and wild-type iHTM cells are grown to confluency and then serially passaged in complete IMEM media supplemented with 10% FBS until growing well. Cells are plated in 24-well plates and left untreated or treated with DEX. DEX (Sigma) stock solution is prepared by adding absolute ethanol to the commercial vial obtaining a final concentration of 0.1 mM and kept at 4° C. The DEX stock solution of 0.1 μM is diluted 1000× (100 nM final concentration) in IMEM media before use. Parallel wells receive IMEM medium containing the drug vehicle under the same conditions. Seventy-two hours after treatment cells are harvested with Cells-to-Ct reagent.

qPCR is performed using the ABI Prism 7900HT Fast Real-Time PCR System (ThermoFisher, Carlsbad, Calif.). Amplification by PCR is performed according to the manufacturer's protocols (ThermoFisher). Primers and probes for the ANGPTL7 protein coding (ENST00000376819) and noncoding (ENST00000476934) transcripts are used to quantitate the relative abundance of protein coding and noncoding transcript arising from the WT, Q175H, R140H and Arg177Ter knock-in iHTM cells.

Gene expression of extracellular matrix and glaucoma related genes are also evaluated from this same experiment using the same qPCR system. These genes include myocilin (MYOC), collagens type I and V (COL1A1 and COL5A1), versican (VCAN) and fibronectin (FN1). The composition and quality of the extracellular matrix in which human trabecular meshwork cells are embedded is directly relevant to the aqueous humor outflow and glaucoma disease pathology.

Northern blots are also performed to quantitate the relative abundance of protein coding and noncoding transcript arising from WT, Q175H, R140H and Arg177Ter knock-in iHTM cells. Knock-in and wild-type iHTM cells are grown to confluency and then serially passaged in complete IMEM media supplemented with 10% FBS until growing well. Cells are plated in 24-well plates and left untreated or treated with DEX. Parallel wells receive IMEM medium containing the drug vehicle under the same conditions. Seventy-two hours after treatment total RNA is extracted for Northern blot using a probe which captures both the protein coding and noncoding ANGPTL7 transcripts.

Western blots are also performed to quantitate the relative abundance of ANGPTL7 protein arising from WT, Q175H R140H and Arg177Ter knock-in iHTM cells. Knock-in and wild-type iHTM cells are grown to confluency and then serially passaged in complete IMEM media supplemented with 10% FBS until growing well. Cells are plated in 24-well plates and left untreated or treated with DEX. Parallel wells receive IMEM medium containing the drug vehicle under the same conditions. Seventy-two hours after treatment cells are trypsinized and cell lysates prepared using a RIPA buffer. Cell lysates and cell culture supernatants are used to perform Western blots using an ANGPTL7 antibody (Abcam) and a GAPDH antibody (Abcam) as a loading control. The Western blot of lysates and supernatants is used to determine if the miss ens variant modulates ANGPTL7 protein abundance or ANGPTL7 protein secretion.

Example 5: Using Human Cells with Known Genotypes to Determine that Protein Altering Variants in ANGPTL7 Alter Transcript and/or Protein Abundance Human EBV-transformed lymphoblastoid cell lines (LCL) from donors that are known heterozygous or homozygous carriers of the minor alleles of rs28991009 (Q175H), rs28991002 (R140H) and rs143435072 (R177Ter) are acquired. A subset of the cells from each donor are transformed to induced pluripotent stem cells and further differentiated to primary human trabecular meshwork cells (pHTM).

LCL and pHTM cells from variant carriers are compared to non-carriers and are used to demonstrate that the protein altering variants in ANGPTL7 result in secretion defects, or alterations in coding and/or noncoding transcript abundance, or alterations in protein abundance, thereby resulting in loss of functional ANGPTL7 protein. LCL and pHTM cells are grown to confluency and then serially passaged in complete IMEM media supplemented with 10% FBS until growing well. Cells are plated in 24-well plates and left untreated or treated with DEX. DEX (Sigma) stock solution is prepared by adding absolute ethanol to the commercial vial obtaining a final concentration of 0.1 mM and kept at 4° C. The DEX stock solution of 0.1 μM is diluted 1000×(100 nM final concentration) in IMEM media before use. Parallel wells receive IMEM medium containing the drug vehicle under the same conditions. Seventy-two hours after treatment cells are harvested with Cells-to-Ct reagent.

qPCR is performed using the ABI Prism 7900HT Fast Real-Time PCR System (ThermoFisher, Carlsbad, Calif.). Amplification by PCR is performed according to the manufacturer's protocols (ThermoFisher). Primers and probes for the ANGPTL7 protein coding (ENST00000376819) and noncoding (ENST00000476934) transcripts are used to quantitate the relative abundance of protein coding and noncoding transcript in LCL and pHTM cells from donors.

Gene expression of extracellular matrix and glaucoma related genes are also evaluated from this same experiment using the same qPCR system. These genes include myocilin (MYOC), collagens type I and V (COL1A1 and COL5A1), versican (VCAN) and fibronectin (FN1). The composition and quality of the extracellular matrix in which human trabecular meshwork cells are embedded is directly relevant to the aqueous humor outflow and glaucoma disease pathology.

Northern blots are also performed to quantitate the relative abundance of protein coding and noncoding transcript in LCL and pHTM donor-derived cells. LCL and pHTM cells are grown to confluency and then serially passaged in complete IMEM media supplemented with 10% FBS until growing well. Cells are plated in 24-well plates and left untreated or treated with DEX. Parallel wells receive IMEM medium containing the drug vehicle under the same conditions. Seventy-two hours after treatment total RNA is extracted for Northern blot using a probe which captures both the protein coding and noncoding ANGPTL7 transcripts.

Western blots are also performed to quantitate the relative abundance of ANGPTL7 protein arising in LCL and pHTM donor-derived cells. LCL and pHTM cells are grown to confluency and then serially passaged in complete IMEM media supplemented with 10% FBS until growing well. Cells are plated in 24-well plates and left untreated or treated with DEX. Parallel wells receive IMEM medium containing the drug vehicle under the same conditions. Seventy-two hours after treatment cells are trypsinized and cell lysates prepared using a RIPA buffer. Cell lysates and cell culture supernatants are used to perform Western blots using an ANGPTL7 antibody (Abcam) and a GAPDH antibody (Abcam) as a loading control. The Western blot of lysates and supernatants is used to determine if the missense variant modulates ANGPTL7 protein abundance or ANGPTL7 protein secretion.

Example 6. RNA Synthesis and Duplex Annealing

1. Oligonucleotide Synthesis:

All oligonucleotides are synthesized on an AKTA oligopilot synthesizer or an ABI 394 synthesizer. Commercially available controlled pore glass solid support (dT-CPG, 500A, Prime Synthesis) and RNA phosphoramidites with standard protecting groups, 5'-0-dimethoxytrityl N6-benzoyl-2'-t-butyldimethylsilyl-adenosine-3'-O—N,N'-diisopropyl-2-cyanoethylphosphoramidite, 5'-0-dimethoxytrityl-N4-acetyl-2'-t-butyldimethylsilyl-cytidine-3'-0-N,N'-diisopropyl-2-cyanoethylphosphoramidite, 5'-0-dimethoxytrityl-N2~isobutiyl-2'-t-butyldimethylsilyl-guanosine-3'-O—N,N'-diisopropyl-2-cyanoethylphosphoramidite, and 5'-0-dimethoxytrityl-2'-t-butyldimethylsilyl-uridine-3'-0-N,N-diisopropyl-2-cyanoethylphosphoramidite (Pierce Nucleic Acids Technologies) are used for the oligonucleotide synthesis unless otherwise specified. The 2'-F phosphoramidites, 5'-O-dimethoxytrityl-N4-acetyl-2'-fluro-cytidine-3'-O—N,N'-diisopropyl-2-cyanoethyl-phosphoramidite and 5'-O-dimethoxytrityl-2'-fluro-uridine-3'-0-N,N'-diisopropyl-2-cyanoethyl-phosphoramidite are purchased from (Promega). All phosphoramidites are used at a concentration of 0.2M in acetonitrile (CH3CN) except for guanosine which is used at 0.2M concentration in 10% THE/ANC (v/v). Coupling/recycling time of 16 minutes is used. The activator is 5-ethyl thiotetrazole (0.75M, American International Chemicals), for the PO-oxidation Iodine/Water/Pyridine is used and the PS-oxidation PADS (2%>) in 2,6-lutidine/ACN (1:1 v/v) is used.

2. Deprotection—1 (Nucleobase Deprotection)

After completion of synthesis, the support is transferred to a 100 ml glass bottle (VWR). The oligonucleotide is cleaved from the support with simultaneous deprotection of base and phosphate groups with 80 mL of a mixture of ethanolic ammonia [ammonia: ethanol (3:1)] for 6.5 h at 55° C. The bottle is cooled briefly on ice and then the ethanolic ammonia mixture is filtered into a new 250 ml bottle. The CPG is washed with 2×40 mL portions of ethanol/water (1:1 v/v). The volume of the mixture is then reduced to ~30 ml by roto-vap. The mixture is then frozen on dry ice and dried under vacuum on a speed vac.

3. Deprotection—II (Removal of 2' TBDMS Group)

The dried residue is resuspended in 26 ml of triethylamine, triethylamine trihydro fluoride (TEA3HF) or pyridine-HF and DMSO (3:4:6) and heated at 60° C. for 90 minutes to remove the tert-butyldimethylsilyl (TBDMS) groups at the 2' position. The reaction is then quenched with 50 ml of 20 mM sodium acetate and pH adjusted to 6.5, and stored in freezer until purification.

4. Analysis

The oligonucleotides are analyzed by high-performance liquid chromatography (HPLC) prior to purification and selection of buffer and column depends on nature of the sequence and or conjugated ligand.

5. HPLC Purification

The ligand conjugated oligonucleotides are purified reverse phase preparative HPLC. The unconjugated oligonucleotides are purified by anion-exchange HPLC on a TSKgel column packed in house. The buffers are 20 mM sodium phosphate (pH 8.5) in 10% CH3CN (buffer A) and 20 mM sodium phosphate (pH 8.5) in 10% CH3CN, 1M NaBr (buffer B). Fractions containing full-length oligonucleotides are pooled, desalted, and lyophilized. Approximately 0.15 OD of desalted oligonucleotides are diluted in water to 150µï and then pipetted in special vials for CGE and LC/MS analysis.

Compounds are finally analyzed by LC-ESMS and CGE.

6. siRNA Preparation

For the preparation of siRNA, equimolar amounts of sense and antisense strand are heated in 1×PBS at 95° C. for 5 min and slowly cooled to room temperature.

Integrity of the duplex is confirmed by HPLC analysis.

Example 7: Selection of Sequences in Order to Identify Therapeutic siRNAs to Modulate Expression of the ANGPTL7 mRNA Screening sets were defined based by bioinformatic analysis. The therapeutic siRNA molecule has to target human ANGPTL7 as well as the ANGPTL7 sequence of at least one toxicology-relevant species, in this case, the non-human primates (NHP) rhesus and cynomolgus monkeys. The key drivers for the design of the screening set were predicted specificity of the siRNAs against the transcriptome of the relevant species as well as cross-reactivity between species. Predicted specificity in human, rhesus monkey, cynomolgus monkey, mouse, rat and dog was determined for sense (S) and antisense (AS) strand. These were assigned a "specificity score" which considers the likelihood of unintended downregulation of any other transcript by full or partial complementarity of an siRNA strand (up to 4 mismatches within positions 2-18) as well as the number and positions of mismatches. Thus, the predicted most likely off-target(s) for antisense and sense strand of each siRNA can be identified. In addition, the number of potential off-targets is used as an additional specificity factor in the specificity score. It is preferable to identify siRNAs with high specificity and a low number of predicted off-targets.

In addition to selecting siRNA sequences with high sequence specificity to ANGPTL7 mRNA, siRNA sequences within the seed region were analyzed for similarity to seed regions of known miRNAs. siRNAs can function in a miRNA like manner via base-pairing with complementary sequences within the 3'-UTR of mRNA molecules. The complementarity typically encompasses the 5'-bases at positions 2-7 of the miRNA (seed region). In order to circumvent siRNAs to act via functional miRNA binding sites, siRNA strands are avoided that contain natural miRNA seed regions. Seed regions identified in miRNAs from human, mouse, rat, rhesus monkey, dog, rabbit and pig are referred to as "conserved". Combining the "specificity score" with miRNA seed analysis yields the "specificity category". This is divided into categories 1-4, with 1 having the highest specificity and 4 having the lowest specificity. Each strand of the siRNA is assigned to a specificity category.

Species cross-reactivity was assessed for human, cynomolgus monkey, rhesus monkey, mouse, rat, dog, and rabbit. The analysis was based on a canonical siRNA design using 19 bases and 17 bases (without considering positions 1 and 19) for cross-reactivity. Full match as well as single mismatch analysis was included.

Analysis of the human Single Nucleotide Polymorphism (SNP) database (NCBI-DB-SNP) to identify siRNAs targeting regions with known SNPs was also carried out in order to identify siRNAs that may be non-functional in individuals containing the SNP. Information regarding the positions of SNPs within the target sequence as well as minor allele frequency (MAF) in case data was obtained in this analysis.

Initial analysis of the relevant ANGPTL7 mRNA sequence revealed few sequences can be identified that fulfil the specificity requirements and at the same time target ANGPTL7 mRNA in all relevant species. Therefore, it was decided to design independent screening subsets for the therapeutic siRNAs.

All siRNAs in these subsets recognize the human ANGPTL7 sequence, as a human cell culture system was selected for determination of in vitro activity. Therefore, all siRNAs in these subsets can be used to target human ANGPTL7 in a therapeutic setting.

The number of 19mer sequences that can be derived from human ANGPTL7 mRNA (NM_021146.4) without consideration of specificity or species cross-reactivity is 2,206 (sense strand SEQ ID NOS: 1-2206). This set would encompass all possible ANGPTL7 siRNA sequences.

Prioritizing sequences for target specificity, species cross-reactivity, miRNA seed region sequences and SNPs as described above yields siRNA subset A. This subset is composed of 207 siRNAs with sense strand SEQ ID NOS: 7, 39, 42, 92, 93, 94, 95, 98, 99, 103, 112, 113, 114, 115, 117, 118, 119, 120, 124, 125, 127, 206, 207, 227, 257, 271, 272, 480, 487, 488, 489, 490, 491, 492, 493, 497, 498, 499, 501, 579, 583, 584, 587, 588, 592, 593, 594, 596, 598, 600, 601, 602, 603, 604, 605, 606, 629, 630, 634, 636, 637, 642, 645, 646, 649, 652, 657, 658, 739, 740, 741, 742, 743, 751, 756, 804, 813, 817, 819, 845, 846, 849, 852, 871, 872, 873, 874, 875, 876, 878, 879, 881, 905, 906, 907, 908, 915, 916, 917, 918, 919, 920, 923, 943, 944, 948, 952, 953, 958, 960, 974, 976, 977, 979, 982, 983, 984, 985, 986, 988, 989, 990, 991, 992, 993, 997, 1000, 1001, 1002, 1003, 1004, 1009, 1011, 1016, 1020, 1021, 1085, 1086, 1087, 1088, 1092, 1094, 1097, 1105, 1107, 1131, 1132, 1133, 1134, 1138, 1140, 1197, 1198, 1199, 1201, 1202, 1260, 1262, 1263, 1264, 1424, 1425, 1427, 1429, 1430, 1434, 1435, 1436, 1438, 1460, 1463, 1524, 1525, 1527, 1528, 1530, 1532, 1533, 1537, 1538, 1539, 1541, 1639, 1640, 1654, 1691, 1692, 1693, 1694, 1762, 1764, 1765, 1794, 1795, 1796, 1797, 1798, 1968, 1969, 2030, 2085, 2087, 2089, 2091, 2095, 2099, and 2192.

The siRNAs in siRNA subset A has the following characteristics:
1. Cross-reactivity: With 19mer in human ANGPTL7 mRNA, with 17mer/19mer in NHP ANGPTL7
2. Specificity category: For human and NHP:—AS2 or better, SS3 or better miRNA seeds: AS+SS strand:— seed region not conserved in human, mouse, and rat and not present in >4 species
3. Off-target frequency: ≤20 human off-targets matched with 2 mismatches by antisense strand
4. SNPs: siRNA target sites do not harbor SNPs with a MAF≥1% (pos. 2-18)

The siRNA sequences in siRNA subset A can further be selected for more stringent specificity to yield siRNA subset B. SiRNA subset B is composed of 173 siRNAs with sense strand SEQ ID NOS: 7, 39, 92, 93, 94, 95, 98, 99, 112, 113, 114, 115, 117, 118, 119, 120, 124, 125, 127, 207, 257, 271, 272, 487, 488, 489, 490, 491, 492, 493, 497, 498, 499, 501, 579, 583, 587, 588, 593, 594, 596, 598, 600, 601, 602, 603, 604, 605, 606, 629, 630, 634, 636, 637, 642, 645, 646, 649, 652, 739, 740, 741, 742, 743, 804, 813, 817, 845, 849, 852, 871, 872, 873, 874, 875, 876, 878, 879, 881, 905, 906, 907, 908, 915, 916, 917, 918, 919, 920, 923, 944, 952, 953, 958, 960, 974, 976, 977, 979, 982, 984, 985, 989, 990, 991, 992, 993, 997, 1000, 1001, 1002, 1003, 1004, 1009, 1016, 1021, 1085, 1086, 1087, 1088, 1092, 1094, 1097, 1105, 1107, 1131, 1132, 1133, 1134, 1138, 1140, 1197, 1198, 1199, 1201, 1202, 1262, 1263, 1424, 1425, 1427, 1429, 1430, 1434, 1435, 1436, 1460, 1463, 1524, 1525, 1527, 1528, 1530, 1532, 1533, 1537, 1538, 1539, 1541, 1639, 1654, 1691, 1692, 1764, 1765, 1794, 1795, 1796, 1797, 1798, 1968, 2091, and 2095.

The siRNAs in siRNA subset B has the following characteristics:
1. Cross-reactivity: With 19mer in human ANGPTL7 mRNA, with 17mer/19mer in NHP ANGPTL7
2. Specificity category: For human and NHP:—AS2 or better, SS3 or better miRNA seeds: AS+SS strand:— seed region not conserved in human, mouse, and rat and not present in >4 species
3. Off-target frequency: ≤15 human off-targets matched with 2 mismatches by antisense strand
4. SNPs: siRNA target sites do not harbor SNPs with a MAF≥1% (pos. 2-18)

The siRNA sequences in siRNA subset B can further be selected for absence of seed regions in the AS strand that are identical to a seed region of known human miRNA to yield siRNA subset C. SiRNA subset C is composed of 120 siRNAs with sense strand SEQ ID NOS: 7, 39, 92, 94, 113, 114, 115, 117, 118, 119, 120, 127, 207, 257, 271, 272, 488, 489, 490, 498, 499, 501, 579, 587, 588, 593, 594, 596, 600, 601, 605, 606, 629, 630, 636, 642, 645, 646, 739, 740, 741, 742, 743, 813, 845, 849, 871, 872, 873, 878, 879, 881, 905, 906, 907, 908, 916, 917, 918, 919, 952, 958, 976, 979, 982, 984, 989, 990, 991, 992, 993, 1000, 1002, 1003, 1004, 1009, 1016, 1087, 1088, 1092, 1094, 1097, 1105, 1107, 1131, 1132, 1133, 1134, 1198, 1199, 1201, 1202, 1262, 1424, 1427, 1434, 1435, 1463, 1524, 1525, 1527, 1528, 1530, 1532, 1533, 1537, 1538, 1541, 1639, 1691, 1692, 1764, 1765, 1794, 1796, 1797, 1798, 1968, 2091, and 2095.

The siRNAs in siRNA subset C has the following characteristics:
1. Cross-reactivity: With 19mer in human ANGPTL7 mRNA, with 17mer/19mer in NHP ANGPTL7
2. Specificity category: For human and NHP:—AS2 or better, SS3 or better miRNA seeds: AS+SS strand:— seed region not conserved in human, mouse, and rat and not present in >4 species. AS strand:—seed region not identical to seed region of known human miRNA
3. Off-target frequency: ≤15 human off-targets matched with 2 mismatches by antisense strand
4. SNPs: siRNA target sites do not harbor SNPs with a MAF≥1% (pos. 2-18)

The siRNA sequences in siRNA subset C can also be selected for absence of seed regions in the AS or S strands that are identical to a seed region of known human miRNA to yield siRNA subset D. SiRNA subset D is composed of 90 siRNAs with sense strand SEQ ID NOS: 92, 113, 115, 119, 120, 127, 488, 490, 499, 579, 587, 588, 592, 593, 594, 600, 601, 605, 606, 630, 642, 657, 658, 740, 742, 743, 813, 846, 871, 872, 878, 881, 905, 907, 916, 917, 918, 919, 943, 948, 958, 979, 982, 983, 984, 989, 990, 991, 992, 1000, 1002, 1003, 1004, 1016, 1020, 1087, 1088, 1097, 1105, 1107, 1131, 1132, 1133, 1134, 1199, 1202, 1260, 1262, 1264, 1427, 1435, 1438, 1463, 1524, 1525, 1527, 1528, 1532, 1538, 1541, 1639, 1692, 1762, 1765, 1794, 1797, 1968, 2030, 2095, and 2192.

The siRNAs in siRNA subset D has the following characteristics:
1. Cross-reactivity: With 19mer in human ANGPTL7 mRNA, with 17mer/19mer in NHP ANGPTL7
2. Specificity category: For human and NHP:—AS2 or better, SS3 or better miRNA seeds: AS+SS strand:—seed region not conserved in human, mouse, and rat and not present in >4 species. AS+SS strand:—seed region not identical to seed region of known human miRNA
3. Off-target frequency: ≤20 human off-targets matched with 2 mismatches by antisense strand
4. SNPs: siRNA target sites do not harbor SNPs with a MAF≥1% (pos. 2-18)

The siRNA sequences in siRNA subset D can further be selected for more stringent specificity to yield siRNA subset E. SiRNA subset E is composed of 76 siRNAs with sense strand SEQ ID NOS: 92, 113, 115, 119, 120, 127, 488, 490, 499, 579, 587, 588, 593, 594, 600, 601, 605, 606, 630, 642, 740, 742, 743, 813, 871, 872, 878, 881, 905, 907, 916, 917, 918, 919, 958, 979, 982, 984, 989, 990, 991, 992, 1000, 1002, 1003, 1004, 1016, 1087, 1088, 1097, 1105, 1107, 1131, 1132, 1133, 1134, 1199, 1202, 1262, 1427, 1435, 1463, 1524, 1525, 1527, 1528, 1532, 1538, 1541, 1639, 1692, 1765, 1794, 1797, 1968, and 2095.

The siRNAs in siRNA subset E has the following characteristics:
1. Cross-reactivity: With 19mer in human ANGPTL7 mRNA, with 17mer/19mer in NHP ANGPTL7
2. Specificity category: For human and NHP:—AS2 or better, SS3 or better miRNA seeds: AS+SS strand:—seed region not conserved in human, mouse, and rat and not present in >4 species. AS+SS strand:—seed region not identical to seed region of known human miRNA
3. Off-target frequency: ≤15 human off-targets matched with 2 mismatches by antisense strand
4. SNPs: siRNA target sites do not harbor SNPs with a MAF≥1% (pos. 2-18)

Example 8: siRNA or Antisense Oligonucleotide (ASO)-Mediated Modulation of ANGPTL7 Expression in Primary Human Trabecular Meshwork Cells (pHTMs) in the Presence and Absence of Dexamethasone (DEX)

In this experiment, siRNA or ASO inhibition of ANGPTL7 is performed in primary human trabecular meshwork cells, to evaluate the efficacy of knockdown of ANGPTL7 and the effect of this on extracellular matrix and glaucoma related genes including myocilin (MYOC), collagens type I and V (COL1A1 and COL5A1), versican (VCAN) and fibronectin (FN1). The composition and quality of the extracellular matrix in which human trabecular meshwork cells are embedded is directly relevant to the aqueous humor outflow and glaucoma disease pathology.

Primary HTM cells are grown to confluency and then serially passaged in complete IMEM media supplemented with 10% FBS until passage 4. Cells are then transfected in a 24-well plate with a non-targeting control or ANGPTL7 targeting siRNA. The ANGPTL7 siRNA has the following sequence: sense strand 5' GUACAACUGCUGCACA-GACUU 3' (SEQ ID NO:11089), antisense strand 5' GUCU-GUGCAGCAGUUGUACUU 3' (SEQ ID NO: 11090). The non-targeting control siRNA has the following sequence: sense strand 5' GUUGUACAGCAUGCGGAGAUU 3' (SEQ ID NO:11091), antisense strand 5' UCUCCG-CAUGCUGUACAACUU 3' (SEQ ID NO: 11092). In parallel, cells are transfected in a 24-well plate with a non-targeting control ASO or ANGPTL7 ASO. The ANGPTL7 ASO has the following sequence: 5' mTsmTsmGsmTsm-AsdCsdCsdAsdGsdTsdAsdGsdCsdCs-dAsmCsmCsmTsmTsmT 3' (SEQ ID NO:11087). The non-targeting control ASO has the following sequence: 5' mTsmCsmTsmAsmAsdCsdCsdGsdAsdGsdCsdTsdGsd-AsdTsmGsmGsmAsmCsmT 3' (SEQ ID NO:11088). Briefly, transfections are performed using TransIT TKO (Mirus) following the manufacturer's recommended protocol. For each well receiving siRNA, 1 ul siRNA (10 uM stock), 2.5 ul TransIT-TKO, and 50 ul OptiMEM are mixed, incubated at room temperature for 30 minutes, and added dropwise to each well containing cells and 1 mL complete IMEM media. For each well receiving ASO, 1 ul ASO (1 mM stock), 2.5 ul TransIT-TKO, and 50 ul OptiMEM are mixed, incubated at room temperature for 30 minutes, and added dropwise to each well containing cells and 1 mL complete IMEM media.

Twenty-four hours after transfection, media is changed and HTM cells are treated with DEX for 48 hours in the presence of serum. DEX (Sigma) stock solution is prepared by adding absolute ethanol to the commercial vial obtaining a final concentration of 0.1 mM and kept at 4° C. The DEX stock solution of 0.1 μM is diluted 1000×(100 nM final concentration) in IMEM media before use. Parallel wells receive IMEM medium containing the drug vehicle under the same conditions. At the end of each treatment, cells are washed two times with PBS, lysed with 350 μL guanidine thiocyanate buffer and processed for RNA extraction.

Total RNA is reverse transcribed to cDNA using a First-Strand III cDNA Synthesis kit. Normalized cDNA quantification is carried out by real-time TaqMan PCR using fluorescently labeled TaqMan probes/primers sets of selected genes (ANGPTL7, MYOC, COL1A1, COL5A1, VCAN, FN1, and PPIA). Reactions are carried out in 20 μL aliquots using TaqMan Universal PCR Master Mix No AmpErase UNG ran on an ABI Prism 7500 Fast Real-Time PCR System Sequence Detection System and analyzed by the 7500 System software. Relative Quantification (RQ) values between treated and untreated samples are calculated by the formula $2^{-\Delta\Delta C_T}$, where $C_T$ is the cycle at threshold (automatic measurement), $\Delta C_T$ is $C_T$ of the assayed gene minus $C_T$ of the endogenous control (PPIA), and $\Delta\Delta C_T$ is the $\Delta C_T$ of the normalized assayed gene in the treated sample minus the $\Delta C_T$ of the same gene in the untreated one (calibrator).

Example 9. siRNA-Mediated Modulation of ANGPTL7 in a Mouse Model of Dexamethasone-Induced Ocular Hypertension/Glaucoma In this experiment, the glucocorticoid-induced mouse model of glaucoma is used to evaluate the effect of siRNA inhibition of ANGPTL7 on IOP. C57BL/6J mice that receive weekly periocular conjunctival fornix (CF) injections of a dexamethasone-21-acetate (Dex-Ac) formulation develop relatively rapid and significant elevation of IOP that is correlated with reduced conventional outflow facility, similar to glaucomatous disease in human patients.

Three routes of delivery are evaluated for siRNA inhibition of ANGPTL7. These include (1) intracameral injection (2) intravitreal injection and (3) topical delivery administered in eye drops.

Adult (6-8 months old) C57BL/6J mice are obtained from the Jackson Laboratory (Bar Harbor, Me.). The animals are kept in environmentally controlled rooms under specific pathogen-free conditions (temperature, 20-26° C.); humidity, 30-70%) with a 12-hour light—dark cycle for 2 weeks before use. Food and water are available ad libitum. All animals are used in accordance with animal care guidelines.

Mice are divided into 9 groups. All treatments are applied to both eyes. Group A (n=4) is an untreated group. Group B (n=4) is a group treated with weekly periocular injections of Dex-Ac (four total treatments). Group C (n=4) is a group treated with vehicle. Group D (n=4) is treated with Dex-Ac and an ANGPTL7 targeting siRNA via intracameral injection into the anterior chamber. Group E (n=4) is treated with Dex-Ac and a non-targeting control siRNA via intracameral injection into the anterior chamber. Group F (n=4) is treated with Dex-Ac and an ANGPTL7 targeting siRNA via intravitreal injection into the posterior chamber. Group G (n=4) is treated with Dex-Ac and a non-targeting control siRNA via intravitreal injection into the posterior chamber. Group H (n=4) is treated with Dex-Ac and an ANGPTL7 targeting siRNA via topical administration of an eye drop. Group I (n=4) is treated with Dex-Ac and a non-targeting control siRNA via topical administration of an eye drop.

The ANGPTL7 siRNA has the following sequence: sense strand 5' GUACAACUGCUGCACAGACUU 3' (SEQ ID NO:11089), antisense strand 5' GUCUGUGCAGCAGUUGUACUU 3' (SEQ ID NO: 11090). Some preferred siRNA sequences may include any one of ETD00342 (sense strand 5' CfsasAfaGfgUfGfGfcUfaCfuGfgUfaAfsusu 3' SEQ ID NO: 11172, antisense strand 5' usUfsaCfcAfgUfaGfccaCfcUfuUfgsusu 3' SEQ ID NO: 11292), ETD00343 (sense strand 5' AfsasGfgUfgGfCfUfaCfuGfgUfaCfaAfsusu 3' SEQ ID NO: 11173, antisense strand 5' usUfsgUfaCfcAfgU-fagcCfaCfcUfususu 3' SEQ ID NO: 11293), ETD00344 (sense strand 5' GfsusGfgCfuAfCfUfgGfuAfcA-faCfuAfsusu 3' SEQ ID NO: 11174, antisense strand 5' usAfsgUfuGfuAfcCfaguAfgCfcAfcsusu 3' SEQ ID NO: 11294), ETD00345 (sense strand 5' UfsgsGfuAfcA-fAfCfuGfcUfgCfaCfaAfsusu3' SEQ ID NO: 11175, antisense strand 5' usUfsgUfgCfaGfcAfguuGfuAfcCfasusu 3' SEQ ID NO: 11295) or ETD00346 (sense strand 5' GfsusAfcAfaCfUfGfcUfgCfaCfaGfaAfsusu 3' SEQ ID NO: 11176, antisense strand 5' usUfscUfgUfgCfaGfcagU-fuGfuAfcsusu 3' SEQ ID NO: 11296). Some embodiments include any one of ETD00342, ETD00343, ETD00344, ETD00345, or ETD00346, but without the modification patterns of any of SEQ ID NOs: 11172-11176 or 11292-11296, or with different modifications or modification patterns than those SEQ ID NOs. A hydrophobic moiety, such as cholesterol, may also be attached to the siRNA A ligand that binds to receptors on the cell surface, such as RGD to integrins, may also be attached to the siRNA. Hydrophobic groups may be combined with cell-targeting ligands to increase cellular uptake. The non-targeting control siRNA has the following sequence: sense strand 5' GUUGUACAG-CAUGCGGAGAUU 3' (SEQ ID NO: 11091), antisense strand 5' UCUCCGCAUGCUGUACAACUU 3' (SEQ ID NO: 11092).

For periocular injection of Dex-Ac or vehicle, a 32-gauge needle with a Hamilton glass microsyringe (25-μL volume; Hamilton Company, Reno, Nev.) is used. The lower eyelid is retracted, and the needle is inserted through the CF. Dex-Ac or vehicle suspension (20 μL) is injected immediately under the CF over the course of 10 to 15 seconds. The needle is then withdrawn. The procedure is performed on both eyes of each animal (each animal receives either Dex-Ac in both eyes or vehicle in both eyes). Mice are treated with Dex-Ac or vehicle once per week until the end of the study.

For intracameral injections, a topical anesthetic (tetracaine hydrochloride 0.5%, Bausch & Lomb) is applied to the eye. 10 ug of siRNA or scrambled control in vehicle is injected using a 36G beveled needle mounted on a 10 μl microsyringe. An UltraMicroPump II (World precision instrument's UMP2 and UMC4) is used to precisely control the volume of injection. The needle is entered at the limbus and care is taken not to traumatize the iris or the lens. Mice with injury to iris or lens are excluded from the study. As the needle is withdrawn after injection, a cotton tip applicator is applied for about 1 minute to prevent aqueous reflux.

For intravitreal injection, a 33-gauge needle with a glass microsyringe (10-μL volume; Hamilton Company) is used. The eye is proptosed, and the needle is inserted through the equatorial sclera and inserted into the vitreous chamber at an angle of approximately 45 degrees, taking care to avoid touching the posterior part of the lens or the retina. 10 ug of siRNA or scrambled control in vehicle is injected into the vitreous over the course of 1 minute. The needle is then left in place for a further 30 seconds (to facilitate mixing), before being rapidly withdrawn.

The study length is 32 days. Oligonucleotide treatment (siRNA or scrambled controls) occurs on days 0 and 14. Dex-Ac treatment occurs once weekly on days 7, 14, 21 and 28. Animals are euthanized and tissues harvested on day 32.

IOP is measured on days 0, 14 and 28, just prior to any treatment. Mice from each group are anaesthetized using intraperitoneal injection (0.1 μl) of ketamine (100 mg/kg) and xylazine (9 mg/kg). One mouse is anaesthetized at a time and IOP is measured as soon as the mouse fails to respond to touch. All care is taken to ensure that the mice are in a similar level of anesthesia when the IOP measurements are made. To measure the IOP, a handheld tonometer (Tono-Lab, Colonial Medical Supply, Franconia, N.H.) is used.

Mice are euthanized on day 32. Both eyes from each animal will be harvested and dissected along the equator, and the anterior hemisphere placed in RNAlater. Total RNA is extracted from homogenized tissue and reverse transcribed to cDNA using a First-Strand III cDNA Synthesis kit. Normalized cDNA quantification is carried out by real-time TaqMan PCR using fluorescently labeled TaqMan probes/primers sets of selected genes (ANGPTL7, MYOC, COL1A1, COL5A1, VCAN, FN1, and PPIA). Reactions are carried out in 20 μL aliquots using TaqMan Universal PCR Master Mix No AmpErase UNG ran on an ABI Prism 7500 Fast Real-Time PCR System Sequence Detection System and analyzed by the 7500 System software. Relative Quantification (RQ) values between treated and untreated samples are calculated by the formula $2^{-\Delta\Delta C_T}$, where $C_T$ is the cycle at threshold (automatic measurement), $\Delta C_T$ is $C_T$ of the assayed gene minus $C_T$ of the endogenous control (PPIA), and $\Delta\Delta C_T$ is the $\Delta C_T$ of the normalized assayed gene in the treated sample minus the $\Delta C_T$ of the same gene in the untreated one (calibrator).

Example 10. Antisense Oligonucleotide (ASO)-Mediated Modulation of ANGPTL7 in a Mouse Model of Dexamethasone-Induced Ocular Hypertension/Glaucoma In this experiment, the glucocorticoid-induced mouse model of glaucoma is used to evaluate the effect of ASO inhibition of ANGPTL7 on IOP. C57BL/6J mice that receive weekly periocular conjunctival fornix (CF) injections of a dexamethasone-21-acetate (Dex-Ac) formulation develop relatively rapid and significant elevation of IOP that is correlated with reduced conventional outflow facility, similar to glaucomatous disease in human patients.

Three routes of delivery are evaluated for ASO inhibition of ANGPTL7. These include (1) intracameral injection (2) intravitreal injection and (3) topical delivery administered in eye drops.

Adult (6-8 months old) C57BL/6J mice are obtained from the Jackson Laboratory (Bar Harbor, Me.). The animals are kept in environmentally controlled rooms under specific pathogen-free conditions (temperature, 20-26° C.); humidity, 30-70%) with a 12-hour light—dark cycle for 2 weeks before use. Food and water are available ad libitum. All animals are used in accordance with animal care guidelines.

Mice are divided into 9 groups. All treatments are applied to both eyes. Group A (n=4) is an untreated group. Group B (n=4) is a group treated with weekly periocular injections of Dex-Ac (four total treatments). Group C (n=4) is a group treated with vehicle. Group D (n=4) is treated with Dex-Ac and an ANGPTL7 targeting ASO via intracameral injection into the anterior chamber. Group E (n=4) is treated with Dex-Ac and a non-targeting control ASO via intracameral injection into the anterior chamber. Group F (n=4) is treated with Dex-Ac and an ANGPTL7 targeting ASO via intravitreal injection into the posterior chamber. Group G (n=4) is treated with Dex-Ac and a non-targeting control ASO via intravitreal injection into the posterior chamber. Group H (n=4) is treated with Dex-Ac and an ANGPTL7 targeting ASO via topical administration of an eye drop. Group I (n=4) is treated with Dex-Ac and anon-targeting control ASO via topical administration of an eye drop.

The ANGPTL7 ASO has the following sequence: 5' mTsmTsmGsmTsmAsdCsdCsdAsdGsdTsdAsdGsdCsdCs-dAsmCsmCsmTsmTsmT 3' (SEQ ID NO: 11087). The non-targeting control ASO has the following sequence: 5' mTsmCsmTsmAsmAsdCsdCsdGsdAsdGsdCsdTsdGsd-AsdTsmGsmGsmAsmCsmT 3' (SEQ ID NO: 11088). A hydrophobic moiety, such as cholesterol, may also be attached to the ASO. A ligand that binds to receptors on the cell surface, such as RGD to integrins, may also be attached to the ASO. Hydrophobic groups may be combined with cell-targeting ligands to increase cellular uptake.

For periocular injection of Dex-Ac or vehicle, a 32-gauge needle with a Hamilton glass microsyringe (25-μL volume; Hamilton Company, Reno, Nev.) is used. The lower eyelid is retracted, and the needle is inserted through the CF. Dex-Ac or vehicle suspension (20 μL) is injected immediately under the CF over the course of 10 to 15 seconds. The needle is then withdrawn. The procedure is performed on both eyes of each animal (each animal receives either Dex-Ac in both eyes or vehicle in both eyes). Mice are treated with Dex-Ac or vehicle once per week until the end of the study.

For intracameral injections, a topical anesthetic (tetracaine hydrochloride 0.5%, Bausch & Lomb) is applied to the eye. 10 ug of ASO or scrambled control in vehicle is injected using a 36G beveled needle mounted on a 10 μl microsyringe. An UltraMicroPump II (World precision instrument's UMP2 and UMC4) is used to precisely control the volume of injection. The needle is entered at the limbus and care is taken not to traumatize the iris or the lens. Mice with injury to iris or lens are excluded from the study. As the needle is withdrawn after injection, a cotton tip applicator is applied for about 1 minute to prevent aqueous reflux.

For intravitreal injection, a 33-gauge needle with a glass microsyringe (10-μL volume; Hamilton Company) is used. The eye is proptosed, and the needle is inserted through the equatorial sclera and inserted into the vitreous chamber at an angle of approximately 45 degrees, taking care to avoid touching the posterior part of the lens or the retina. 10 ug of ASO or scrambled control in vehicle is injected into the vitreous over the course of 1 minute. The needle is then left in place for a further 30 seconds (to facilitate mixing), before being rapidly withdrawn.

The study length is 32 days. Oligonucleotide treatment (ASO or scrambled controls) occurs on days 0 and 14. Dex-Ac treatment occurs once weekly on days 7, 14, 21 and 28. Animals are euthanized and tissues harvested on day 32.

IOP is measured on days 0, 14 and 28, just prior to any treatment. Mice from each group are anaesthetized using intraperitoneal injection (0.1 μl) of ketamine (100 mg/kg) and xylazine (9 mg/kg). One mouse is anaesthetized at a time and IOP is measured as soon as the mouse fails to respond to touch. All care is taken to ensure that the mice are in a similar level of anesthesia when the IOP measurements are made. To measure the IOP, a handheld tonometer (Tono-Lab, Colonial Medical Supply, Franconia, N.H.) is used.

Mice are euthanized on day 32. Both eyes from each animal will be harvested and dissected along the equator, and the anterior hemisphere placed in RNAlater. Total RNA is extracted from homogenized tissue and reverse transcribed to cDNA using a First-Strand III cDNA Synthesis kit. Normalized cDNA quantification is carried out by real-time TaqMan PCR using fluorescently labeled TaqMan probes/primers sets of selected genes (ANGPTL7, MYOC, COL1A1, COL5A1, VCAN, FN1, and PPIA). Reactions are carried out in 20 μL aliquots using TaqMan Universal PCR Master Mix No AmpErase UNG ran on an ABI Prism 7500 Fast Real-Time PCR System Sequence Detection System and analyzed by the 7500 System software. Relative Quantification (RQ) values between treated and untreated samples are calculated by the formula $2^{-\Delta\Delta C_T}$, where $C_T$ is the cycle at threshold (automatic measurement), $\Delta C_T$ is $C_T$ of the assayed gene minus $C_T$ of the endogenous control (PPIA), and $\Delta\Delta C_T$ is the $\Delta C_T$ of the normalized assayed gene in the treated sample minus the $\Delta C_T$ of the same gene in the untreated one (calibrator).

Example 11: siRNA or Antisense Oligonucleotide (ASO)-Mediated Modulation of ANGPTL7 in a Mouse Model of Spontaneous Glaucoma In this experiment, the DBA/2J mouse model of glaucoma is used to evaluate the effect of siRNA or ASO inhibition of ANGPTL7 on IOP. DBA/J2 mice develop age related IOP increases and retinal nerve damage characteristic of human disease. DBA/2J mice normally demonstrate peak IOP elevation at 8 months of age.

Adult mice from inbred strains DBA/2J are obtained from the Jackson Laboratory (Bar Harbor, Me.). The animals are kept in environmentally controlled rooms under specific pathogen-free conditions (temperature, 20-26° C.); humidity, 30-70%) with a 12-hour light—dark cycle for 2 weeks before use. Food and water are available ad libitum. All animals are used in accordance with animal care guidelines.

Experiments are performed on 6-month-old mice. Mice are divided into six groups. Group A (n=4) is an untreated control group. Group B (n=4) is treated with ANGPTL7 targeting siRNA via intraocular/intracameral injection into the anterior chamber. Group C (n=4) is treated with a non-targeting control siRNA via intraocular injection into the anterior chamber. Group D (n=4) is treated with ANGPTL7 targeting ASO via intraocular injection into the anterior chamber. Group E (n=4) is treated with a non-targeting control MO via intraocular injection into the anterior chamber. Group F (n=4) is treated with vehicle.

The ANGPTL7 siRNA has the following sequence: sense strand 5' GUACAACUGCUGCACAGACUU 3' (SEQ ID NO:11089), antisense strand 5' GUCUGUGCAGCAGUU-GUACUU 3' (SEQ ID NO: 11090). The non-targeting control siRNA has the following sequence: sense strand 5' GUUGUACAGCAUGCGGAGAUU 3' (SEQ ID NO: 11091), antisense strand 5' UCUCCGCAUGCUGUA-CAACUU 3' (SEQ ID NO: 11092). Some preferred siRNA sequences may include any one of ETD00342 (sense strand 5' CfsasAfaGfgUfGfGfcUfaCfuGfgUfaAfsusu 3' SEQ ID NO: 11172, antisense strand 5' usUfsaCfcAfgUfaGfccaCf-cUfuUfgsusu 3' SEQ ID NO: 11292), ETD00343 (sense strand 5' AfsasGfgUfgGfCfUfaCfuGfgUfaCfaAfsusu 3' SEQ ID NO: 11173, antisense strand 5' usUfsgUfaCfcAfgU-fagcCfaCfcUfsusu 3' SEQ ID NO: 11293), ETD00344 (sense strand 5' GfsusGfgCfuAfCfUfgGfuAfcA-faCfuAfsusu 3' SEQ ID NO: 11174, antisense strand 5' usAfsgUfuGfuAfcCfaguAfgCfcAfcsusu 3' SEQ ID NO: 11294), ETD00345 (sense strand 5' UfsgsGfuAfcA-fAfCfuUfgGfcUfgCfaCfaAfsusu 3' SEQ ID NO: 11175, antisense strand 5' usUfsgUfgCfaGfcAfguuGfuAfcCfasusu 3' SEQ ID NO: 11295) or ETD00346 (sense strand 5' GfsusAfcAfaCfUfGfcUfgCfaCfaGfaAfsusu 3' SEQ ID NO: 11176, antisense strand 5' usUfscUfgUfgCfaGfcagU-fuGfuAfcsusu 3' SEQ ID NO: 11296). Some embodiments include any one of ETD00342, ETD00343, ETD00344, ETD00345, or ETD00346, but without the modification patterns of any of SEQ ID NOs: 11172-11176 or 11292-11296, or with different modifications or modification patterns than those SEQ ID NOs. A hydrophobic moiety, such as cholesterol, may also be attached to the siRNA A ligand that binds to receptors on the cell surface, such as RGD to integrins, may also be attached to the siRNA. Hydrophobic groups may be combined with cell-targeting ligands to increase cellular uptake.

The ANGPTL7 ASO has the following sequence: 5' mTsmTsmGsmTsmAsdCsdCsdAsdGsdTsdAsdGsdCsdCs-dAsmCsmCsmTsmTsmT 3' (SEQ ID NO: 11087). The non-targeting control ASO has the following sequence: 5' mTsmCsmTsmAsmAsdCsdCsdGsdAsdGsdCsdTsdGsd-AsdTsmGsmGsmAsmCsmT 3' (SEQ ID NO: 11088). A hydrophobic moiety, such as cholesterol, could also be attached to the ASO. A ligand that binds to receptors on the cell surface, such as RGD to integrins, may also be attached to the ASO. Hydrophobic groups may be combined with cell-targeting ligands to increase cellular uptake.

For intracameral injections, a topical anesthetic (tetracaine hydrochloride 0.5%, Bausch & Lomb) is applied to the desired eye. 10 ug of siRNA or ASO in a 1 ul of vehicle is injected using a 36G beveled needle mounted on a 10 μl microsyringe. An UltraMicroPump II (World precision instrument's UMP2 and UMC4) is used to precisely control the volume of injection. The needle is entered at the limbus and care is taken not to traumatize the iris or the lens. Mice with injury to iris or lens are excluded from the study. As the needle is withdrawn after injection, a cotton tip applicator is applied for about 1 minute to prevent aqueous reflux.

IOP is measured a day prior to injections, and also measured at two, four, six- and eight-weeks post-injection. Mice from each group are anaesthetized using intraperitoneal injection (0.1 μl) of ketamine (100 mg/kg) and xylazine (9 mg/kg). One mouse is anaesthetized at a time and IOP is measured as soon as the mouse fails to respond to touch. All care is taken to ensure that the mice are in a similar level of anesthesia when the IOP measurements are made. To measure the IOP, a handheld tonometer (TonoLab, Colonial Medical Supply, Franconia, N.H.) is used.

Mice are euthanized after the final, eight-week IOP measurements. Trabecular meshwork tissue is dissected out of the enucleated eyes under a dissecting microscope and prepared for RNA extraction. Total RNA is reverse transcribed to cDNA using a First-Strand III cDNA Synthesis kit. Normalized cDNA quantification is carried out by real-time TaqMan PCR using fluorescently labeled TaqMan probes/primers sets of selected genes (ANGPTL7, MYOC, COL1A1, COL5A1, VCAN, FN1, and PPIA). Reactions are carried out in 20 μL aliquots using TaqMan Universal PCR Master Mix No AmpErase UNG ran on an ABI Prism 7500 Fast Real-Time PCR System Sequence Detection System and analyzed by the 7500 System software. Relative Quantification (RQ) values between treated and untreated samples are calculated by the formula $2^{-\Delta\Delta C_T}$, where $C_T$ is the cycle at threshold (automatic measurement), $\Delta C_T$ is $C_T$ of the assayed gene minus $C_T$ of the endogenous control (PPIA), and $\Delta\Delta C_T$ is the $\Delta C_T$ of the normalized assayed gene in the treated sample minus the $\Delta C_T$ of the same gene in the untreated one (calibrator).

Example 12: Chemically Modified ANGPTL7 siRNAs

The siRNAs targeting ANGPTL7 can be synthesized with chemical modifications with the sense strand having the pattern 5' NfsnsNfnNfnNfnNfnNfnNfnNfnNfnNfnNfsnsn 3' (Modification pattern 1S, SEQ ID NO: 11381) and the antisense strand having the pattern nsNfsnNfnNfnNfnNfnNfnnnNfnNfnNfsnsn 3' (Modification pattern 1AS, SEQ ID NO: 11386). "N" can be any nucleoside (for example ribose, deoxyribose, or derivatives thereof), "Nf" is a 2' fluoro-modified nucleoside, "n" is a 2' O-methyl modified nucleoside, and "s" is a phosphorothioate linkage. In addition, adenosine can be placed at position 19 in the sense strand and uridine at position 1 in the antisense strand. Some siRNAs that may include these chemical modifications comprise sequences of any of SEQ ID NOs: 11093-11376.

The siRNAs targeting ANGPTL7 can also be synthesized with chemical modifications with the sense strand having the pattern of modifications 5' nsnsnnNfnNfNfNfnnnnnnnnnnnsnsn (SEQ ID NO: 11382) and antisense strand having the pattern of modifications 5' nsNfsnnnNfnnnnnnnNfnNfnnnsnsn 3' (SEQ ID NO: 11388). "N" can be any nucleoside (for example ribose, deoxyribose, or derivatives thereof), "Nf" is a 2' fluoro-modified nucleoside, "n" is a 2' O-methyl modified nucleoside, and "s" is a phosphorothioate linkage. In addition, adenosine can be placed at position 19 in the sense strand and uridine at position 1 in the antisense strand.

Example 13. Screening ANGPTL7 siRNAs for Activity in Human Cells in Culture

Chemically modified ANGPTL7 siRNAs cross reactive for human and non-human primate and derived from sequences in siRNA subset C were assayed for ANGPTL7 mRNA knockdown activity in cells in culture. ARPE-19 (ATCC® CRL-2302™) cells were seeded in 96-well tissue culture plates at a cell density of 7,500 cells per well in DMEM:F12 (ATCC Catalog No. 30-2006) supplemented with 10% fetal bovine serum and incubated overnight in a water-jacketed, humidified incubator at 37° C. in an atmosphere composed of air plus 5% carbon dioxide. The ANGPTL7 siRNAs were individually transfected into ARPE-19 cells in duplicate wells at 10 nM final concentration using 0.3 μL Lipofectamine RNAiMax (Fisher) per well. Silencer Select Negative Control #1 (ThermoFisher, Catalog #4390843) was transfected at 10 nM final concentration as a control. After incubation for 48 hours at 37° C., total RNA was harvested from each well and cDNA prepared using TagMan® Fast Advanced Cells-to-$C_T$™ Kit (ThermoFisher, Catalog #A35374) according to the manufacturer's instructions. The level of ANGPTL7 mRNA from each well was measured in triplicate by real-time qPCR on an Applied Biosystems 7500 Fast Real-Time PCR machine using TaqMan Gene Expression Assay for human ANGPTL7 (ThermoFisher, assay #Hs00221727_m1). The level of PPIA mRNA was measured using TaqMan Gene Expression Assay (ThermoFisher, assay #Hs99999904_m1) and used to determine relative ANGPTL7 mRNA levels in each well using the delta-delta Ct method. All data were normalized to relative ANGPTL7 mRNA levels in untreated ARPE-19 cells. Results are shown in Table 5.

TABLE 5

Knockdown Activity of ANGPLT7-Specific siRNAs at 10 nM in Human ARPE-19 Cells

| siRNA name | Sense Strand (SEQ ID NO) | Antisense Strand (SEQ ID NO) | Relative ANGPTL7 Expression |
|---|---|---|---|
| Untreated Cells | — | — | 1.00 |
| Negative Control siRNA | — | — | 0.67 |
| ETD00263 | 11093 | 11213 | 0.72 |
| ETD00264 | 11094 | 11214 | 0.34 |
| ETD00265 | 11095 | 11215 | 0.33 |
| ETD00266 | 11096 | 11216 | 0.26 |
| ETD00267 | 11097 | 11217 | 0.24 |
| ETD00268 | 11098 | 11218 | 0.29 |
| ETD00269 | 11099 | 11219 | 0.18 |
| ETD00270 | 11100 | 11220 | 0.09 |
| ETD00271 | 11101 | 11221 | 0.23 |
| ETD00272 | 11102 | 11222 | 0.22 |
| ETD00273 | 11103 | 11223 | 0.19 |
| ETD00274 | 11104 | 11224 | 0.09 |
| ETD00275 | 11105 | 11225 | 0.14 |
| ETD00276 | 11106 | 11226 | 0.18 |
| ETD00277 | 11107 | 11227 | 0.77 |
| ETD00278 | 11108 | 11228 | 0.58 |
| ETD00279 | 11109 | 11229 | 0.26 |
| ETD00280 | 11110 | 11230 | 0.15 |
| ETD00281 | 11111 | 11231 | 1.64 |
| ETD00282 | 11112 | 11232 | 0.95 |
| ETD00283 | 11113 | 11233 | 0.29 |
| ETD00284 | 11114 | 11234 | 0.54 |
| ETD00285 | 11115 | 11235 | 0.53 |
| ETD00286 | 11116 | 11236 | 0.16 |
| ETD00287 | 11117 | 11237 | 0.80 |
| ETD00288 | 11118 | 11238 | 0.14 |
| ETD00289 | 11119 | 11239 | 0.22 |
| ETD00290 | 11120 | 11240 | 0.60 |
| ETD00291 | 11121 | 11241 | 0.20 |
| ETD00292 | 11122 | 11242 | 0.34 |
| ETD00293 | 11123 | 11243 | 0.25 |
| ETD00294 | 11124 | 11244 | 0.18 |
| ETD00295 | 11125 | 11245 | 0.07 |
| ETD00296 | 11126 | 11246 | 0.06 |
| ETD00297 | 11127 | 11247 | 0.16 |
| ETD00298 | 11128 | 11248 | 0.14 |
| ETD00299 | 11129 | 11249 | 0.33 |
| ETD00300 | 11130 | 11250 | 0.49 |
| ETD00301 | 11131 | 11251 | 0.60 |
| ETD00302 | 11132 | 11252 | 0.17 |
| ETD00303 | 11133 | 11253 | 0.37 |
| ETD00304 | 11134 | 11254 | 0.27 |
| ETD00305 | 11135 | 11255 | 0.36 |
| ETD00306 | 11136 | 11256 | 0.30 |
| ETD00307 | 11137 | 11257 | 0.77 |
| ETD00308 | 11138 | 11258 | 0.93 |
| ETD00309 | 11139 | 11259 | 0.31 |
| ETD00310 | 11140 | 11260 | 0.37 |
| ETD00311 | 11141 | 11261 | 0.84 |
| ETD00312 | 11142 | 11262 | 1.69 |
| ETD00313 | 11143 | 11263 | 0.13 |
| ETD00314 | 11144 | 11264 | 0.24 |
| ETD00315 | 11145 | 11265 | 0.11 |
| ETD00316 | 11146 | 11266 | 0.16 |
| ETD00317 | 11147 | 11267 | 0.14 |
| ETD00318 | 11148 | 11268 | 0.21 |
| ETD00319 | 11149 | 11269 | 0.27 |
| ETD00320 | 11150 | 11270 | 0.11 |
| ETD00321 | 11151 | 11271 | 0.14 |
| ETD00322 | 11152 | 11272 | 0.08 |
| ETD00323 | 11153 | 11273 | 0.32 |
| ETD00324 | 11154 | 11274 | 0.44 |
| ETD00325 | 11155 | 11275 | 0.17 |
| ETD00326 | 11156 | 11276 | 0.18 |
| ETD00327 | 11157 | 11277 | 0.34 |
| ETD00328 | 11158 | 11278 | 0.17 |
| ETD00329 | 11159 | 11279 | 0.08 |
| ETD00330 | 11160 | 11280 | 0.11 |
| ETD00331 | 11161 | 11281 | 0.08 |
| ETD00332 | 11162 | 11282 | 0.17 |
| ETD00333 | 11163 | 11283 | 0.31 |
| ETD00334 | 11164 | 11284 | 0.41 |
| ETD00335 | 11165 | 11285 | 0.06 |
| ETD00336 | 11166 | 11286 | 0.22 |
| ETD00337 | 11167 | 11287 | 0.12 |
| ETD00338 | 11168 | 11288 | 0.19 |
| ETD00339 | 11169 | 11289 | 0.17 |
| ETD00340 | 11170 | 11290 | 0.18 |
| ETD00341 | 11171 | 11291 | 0.13 |
| ETD00342 | 11172 | 11292 | 0.13 |
| ETD00343 | 11173 | 11293 | 0.32 |
| ETD00344 | 11174 | 11294 | 0.22 |
| ETD00345 | 11175 | 11295 | 0.37 |
| ETD00346 | 11176 | 11296 | 0.14 |
| ETD00347 | 11177 | 11297 | 0.20 |
| ETD00348 | 11178 | 11298 | 0.20 |
| ETD00349 | 11179 | 11299 | 0.65 |
| ETD00350 | 11180 | 11300 | 0.34 |
| ETD00351 | 11181 | 11301 | 0.13 |
| ETD00352 | 11182 | 11302 | 0.11 |
| ETD00353 | 11183 | 11303 | 0.11 |
| ETD00354 | 11184 | 11304 | 0.14 |
| ETD00355 | 11185 | 11305 | 0.13 |
| ETD00356 | 11186 | 11306 | 0.10 |
| ETD00357 | 11187 | 11307 | 0.38 |
| ETD00358 | 11188 | 11308 | 0.05 |
| ETD00359 | 11189 | 11309 | 0.11 |
| ETD00360 | 11190 | 11310 | 2.23 |
| ETD00361 | 11191 | 11311 | 0.42 |
| ETD00362 | 11192 | 11312 | 0.61 |
| ETD00363 | 11193 | 11313 | 0.48 |
| ETD00364 | 11194 | 11314 | 0.65 |
| ETD00365 | 11195 | 11315 | 0.24 |
| ETD00366 | 11196 | 11316 | 0.38 |
| ETD00367 | 11197 | 11317 | 0.77 |
| ETD00368 | 11198 | 11318 | 0.16 |
| ETD00369 | 11199 | 11319 | 0.11 |
| ETD00370 | 11200 | 11320 | 0.43 |
| ETD00371 | 11201 | 11321 | 0.35 |
| ETD00372 | 11202 | 11322 | 0.79 |
| ETD00373 | 11203 | 11323 | 0.45 |
| ETD00374 | 11204 | 11324 | 0.34 |
| ETD00375 | 11205 | 11325 | 0.15 |

TABLE 5-continued

Knockdown Activity of ANGPLT7-Specific siRNAs at 10 nM in Human ARPE-19 Cells

| siRNA name | Sense Strand (SEQ ID NO) | Antisense Strand (SEQ ID NO) | Relative ANGPTL7 Expression |
|---|---|---|---|
| ETD00376 | 11206 | 11326 | 0.64 |
| ETD00377 | 11207 | 11327 | 0.29 |
| ETD00378 | 11208 | 11328 | 0.17 |
| ETD00379 | 11209 | 11329 | 0.56 |
| ETD00380 | 11210 | 11330 | 0.36 |
| ETD00381 | 11211 | 11331 | 0.42 |
| ETD00382 | 11212 | 11332 | 0.19 |

"—" untreated ARPE-19 cells; Negative Control siRNA, Silencer Select Negative Control #1

A subset of the ANGPTL7 siRNA at were tested in a second screen for activity at 1 nM concentration using ARPE-19 cells and the transfection procedures as described above. Results are shown in Table 6.

TABLE 6

Knockdown Activity of ANGPLT7-Specific siRNAs at 1 nM in Human ARPE-19 Cell

| siRNA name | Sense Strand (SEQ ID NO) | Antisense Strand (SEQ ID NO) | Relative ANGPTL7 Expression |
|---|---|---|---|
| Untreated Cells | — | — | 1.00 |
| Negative Control siRNA | — | — | 1.06 |
| ETD00269 | 11100 | 11220 | 0.16 |
| ETD00270 | 11143 | 11263 | 0.19 |
| ETD00273 | 11161 | 11281 | 0.27 |
| ETD00276 | 11183 | 11303 | 0.21 |
| ETD00280 | 11186 | 11306 | 0.28 |
| ETD00286 | 11188 | 11308 | 0.43 |
| ETD00291 | 11099 | 11219 | 0.47 |
| ETD00294 | 11103 | 11223 | 0.41 |
| ETD00297 | 11106 | 11226 | 0.45 |
| ETD00302 | 11110 | 11230 | 0.13 |
| ETD00313 | 11116 | 11236 | 0.34 |
| ETD00316 | 11121 | 11241 | 0.31 |
| ETD00318 | 11124 | 11244 | 0.42 |
| ETD00325 | 11127 | 11247 | 0.50 |
| ETD00326 | 11132 | 11252 | 0.67 |
| ETD00328 | 11146 | 11266 | 0.49 |
| ETD00331 | 11148 | 11268 | 0.39 |
| ETD00332 | 11155 | 11275 | 1.09 |
| ETD00338 | 11156 | 11276 | 0.96 |
| ETD00339 | 11158 | 11278 | 0.27 |
| ETD00340 | 11162 | 11282 | 0.31 |
| ETD00347 | 11168 | 11288 | 0.46 |
| ETD00348 | 11169 | 11289 | 0.45 |
| ETD00353 | 11170 | 11290 | 0.53 |
| ETD00356 | 11177 | 11297 | 0.21 |
| ETD00358 | 11178 | 11298 | 0.31 |
| ETD00368 | 11198 | 11318 | 0.48 |
| ETD00375 | 11205 | 11325 | 0.44 |
| ETD00378 | 11208 | 11328 | 0.51 |
| ETD00382 | 11212 | 11332 | 0.28 |

"—" untreated ARPE-19 cells; Negative Control siRNA, Silencer Select Negative Control #1

Example 14. Screening ANGPTL7 siRNAs for Activity in Mouse Cells in Culture

It can be advantageous to possess ANGPTL7 siRNAs that are cross-reactive for human and rodent species. Chemically modified ANGPTL7 siRNAs derived from those that are predicted to be cross-reactive for human and mouse ANGPTL7 were assayed for ANGPTL7 mRNA knockdown activity in mouse cells in culture. C166 (ATCC® CRL-2581™) cells were seeded in 96-well tissue culture plates at a cell density of 10,000 cells per well in DMEM supplemented with 10% fetal bovine serum and incubated overnight in a water jacketed, humidified incubator at 37° C. in an atmosphere composed of air plus 5% carbon dioxide. The ANGPTL7 siRNAs were individually transfected into C166 cells in duplicate wells at 1 nM and 10 nM final concentration using 0.3 µL Lipofectamine RNAiMax (Fisher) per well. Silencer Select Negative Control #1 (ThermoFisher, Catalog #4390843) was transfected at 10 nM final concentration as a control. After incubation for 48 hours at 37° C., total RNA was harvested from each well and cDNA prepared using TaqMan® Fast Advanced Cells-to-$C_T$™ Kit (ThermoFisher, Catalog #A35374) according to the manufacturer's instructions. The level of ANGPTL7 mRNA from each well was measured in triplicate by real-time qPCR on an Applied Biosystems 7500 Fast Real-Time PCR machine using TaqMan Gene Expression Assay for mouse ANGPTL7 (ThermoFisher, assay #Mm00480431_m1). The level of PPIA mRNA was measured using TaqMan Gene Expression Assay (ThermoFisher, assay #Mm02342430_g1) and used to determine relative ANGPTL7 mRNA levels in each well using the delta-delta Ct method. All data were normalized to relative ANGPTL7 mRNA levels in untreated C166 cells. Results are shown in Table 7. In some embodiments, an oligonucleotide such as an siRNA described herein, that targets human ANGPTL7 is cross-reactive with human, NHP, mouse, rat, and/or dog ANGPTL7 (e.g. any one of ETD00342-ETD00346, or a version thereof with different sequence modifications, or without sequence modifications).

TABLE 7

Knockdown Activity of ANGPLT7-Specific siRNAs at 1 nM and 10 nM in Mouse C166 cells

| siRNA name | Sense Strand (SEQ ID NO) | Antisense Strand (SEQ ID NO) | Relative ANGPTL7 Expression | |
|---|---|---|---|---|
| | | | 1 nM siRNA | 10 nM siRNA |
| Untreated Cells | — | — | 1.00 | — |
| Negative Control siRNA | — | — | 0.66 | — |
| ETD00241 | 11333 | 11355 | 1.04 | 0.92 |
| ETD00242 | 11334 | 11356 | 0.71 | 0.78 |
| ETD00243 | 11335 | 11357 | 0.85 | 0.83 |
| ETD00244 | 11336 | 11358 | 0.54 | 0.79 |
| ETD00245 | 11337 | 11359 | 0.43 | 0.71 |
| ETD00246 | 11338 | 11360 | 0.59 | 0.83 |
| ETD00247 | 11339 | 11361 | 0.35 | 0.76 |
| ETD00248 | 11340 | 11362 | 0.93 | 0.90 |
| ETD00249 | 11341 | 11363 | 0.67 | 0.90 |
| ETD00250 | 11342 | 11364 | 0.77 | 0.89 |
| ETD00251 | 11343 | 11365 | 0.52 | 0.82 |
| ETD00252 | 11344 | 11366 | 0.44 | 0.77 |
| ETD00253 | 11345 | 11367 | 0.82 | 0.81 |
| ETD00254 | 11346 | 11368 | 0.94 | 0.87 |
| ETD00255 | 11347 | 11369 | 0.76 | 0.83 |
| ETD00256 | 11348 | 11370 | 0.89 | 0.91 |
| ETD00257 | 11349 | 11371 | 0.52 | 0.92 |
| ETD00258 | 11350 | 11372 | 0.89 | 0.94 |
| ETD00259 | 11351 | 11373 | 0.70 | 0.91 |
| ETD00260 | 11352 | 11374 | 0.52 | 0.92 |
| ETD00261 | 11353 | 11375 | 0.55 | 0.89 |
| ETD00262 | 11354 | 11376 | 0.78 | 0.95 |

"—" untreated C166 cells; Negative Control siRNA Silencer Select Negative Control #1

Example 15. Determining the IC50 of ANGPTL7 siRNAs in Human ARPE-19 Cells

The IC50 values for knockdown of ANGPTL7 mRNA by select ANGPTL7 siRNAs were determined in ARPE-19 cells. The ETD00269, ETD00270, ETD00353, ETD00356, ETD00358, ETD00370, ETD00377, ETD00378 and ETD00382 siRNAs were assayed individually at 3 nM, 1 nM, 0.3 nM, 0.1 nM and 0.03 nM. A subset of siRNAs was also assayed at 0.01 nM. The ARPE-19 (ATCC® CRL-2302™) cells were seeded in 96-well tissue culture plates at a cell density of 7,500 cells per well in DMEM supplemented with 10% fetal bovine serum and incubated overnight in a water-jacketed, humidified incubator at 37° C. in an atmosphere composed of air plus 5% carbon dioxide. The ANGPTL7 siRNAs were individually transfected into ARPE-19 cells in triplicate wells using 0.3 µL Lipofectamine RNAiMax (Fisher) per well. Silencer Select Negative Control #1 (ThermoFisher, Catalog #4390843) was transfected at 0.03 and 3 nM final concentration as a control. After incubation for 48 hours at 37° C., total RNA was harvested from each well and cDNA prepared using TaqMan® Fast Advanced Cells-to-$C_T$™ Kit (ThermoFisher, Catalog #A35374) according to the manufacturer's instructions. The level of ANGPTL7 mRNA from each well was measured in triplicate by real-time qPCR on an Applied Biosystems 7500 Fast Real-Time PCR machine using TaqMan Gene Expression Assay for human ANGPTL7 (ThermoFisher, assay #Hs00221727_m1). The level of PPIA mRNA was measured using TaqMan Gene Expression Assay (ThermoFisher, assay #Hs99999904_m1) and used to determine relative ANGPTL7 mRNA levels in each well using the delta-delta Ct method. All data were normalized to relative ANGPTL7 mRNA levels in untreated ARPE-19 cells. Curve fit was accomplish using the [inhibitor] vs. response (three parameters) function in GraphPad Prism software. Results are shown in Table 8, Table 9, and Table 10.

TABLE 8

IC50 Values of ETD00269, ETD00270, ETD00358 and ETD00382 ANGPIL7 siRNAs

| siRNA | [siRNA] | Relative ANGPTL7 mRNA Levels | IC50 |
|---|---|---|---|
| — | — | 1.000 | ND |
| Negative Control siRNA | 3 nM | 0.713 | ND |
|  | 0.03 nM | 0.712 | ND |
| ETD00269 | 3 nM | 0.156 | 0.23 |
|  | 1 nM | 0.649 |  |
|  | 0.3 nM | 0.849 |  |
|  | 0.1 nM | 1.469 |  |
|  | 0.03 nM | 1.808 |  |
| ETD00270 | 3 nM | 0.305 | 0.044 |
|  | 1 nM | 0.445 |  |
|  | 0.3 nM | 0.225 |  |
|  | 0.1 nM | 0.720 |  |
|  | 0.03 nM | 0.907 |  |
| ETD00358 | 3 nM | 0.129 | 0.15 |
|  | 1 nM | 0.140 |  |
|  | 0.3 nM | 0.553 |  |
|  | 0.1 nM | 0.936 |  |
|  | 0.03 nM | 1.292 |  |
| ETD00382 | 3 nM | 0.316 | 0.28 |
|  | 1 nM | 0.492 |  |
|  | 0.3 nM | 0.229 |  |
|  | 0.1 nM | 0.205 |  |
|  | 0.03 nM | 0.206 |  |

TABLE 9

IC50 Values of ETD00353 and ETD00356 ANGPTL7 siRNAs

| siRNA | [siRNA] | Relative ANGPTL7 mRNA Levels | IC50 |
|---|---|---|---|
| — | — | 1.000 | ND |
| Negative Control siRNA | 3 nM | 1.487 | ND |
|  | 0.03 nM | 0.188 | ND |
| ETD00353 | 3 nM | 0.383 | 1.52 |
|  | 1 nM | 0.772 |  |
|  | 0.3 nM | 1.140 |  |
|  | 0.1 nM | 1.423 |  |
|  | 0.03 nM | 1.257 |  |
|  | 0.01 nM | 1.424 |  |
| ETD00356 | 3 nM | 0.107 | 0.12 |
|  | 1 nM | 0.152 |  |
|  | 0.3 nM | 0.294 |  |
|  | 0.1 nM | 0.712 |  |
|  | 0.03 nM | 0.793 |  |
|  | 0.01 nM | 1.073 |  |

TABLE 10

IC50 Values of ETD00370, ETD00377 and ETD00378 ANGPTL7 siRNAs

| siRNA | [siRNA] | Relative ANGPTL7 mRNA Levels | IC50 |
|---|---|---|---|
| — | — | 1.000 | ND |
| Negative Control siRNA | 0.03 nM | 1.951 | ND |
|  | 3 nM | 1.579 | ND |
| ETD00370 | 3 nM | 0.251 | 0.49 |
|  | 1 nM | 0.589 |  |
|  | 0.3 nM | 0.990 |  |
|  | 0.1 nM | 1.736 |  |
|  | 0.03 nM | 1.566 |  |
| ETD00377 | 3 nM | 0.358 | 2.64 |
|  | 1 nM | 0.462 |  |
|  | 0.3 nM | 0.476 |  |
|  | 0.1 nM | 0.548 |  |
|  | 0.03 nM | 1.361 |  |
| ETD00378 | 3 nM | 0.281 | 0.17 |
|  | 1 nM | 0.575 |  |
|  | 0.3 nM | 1.037 |  |
|  | 0.1 nM | 1.570 |  |
|  | 0.03 nM | 1.816 |  |

Example 16. Assessing the Extent of Nuclease Resistance of ANGPTL7 siRNAs

Resistance of select ANGPTL7 siRNAs to nuclease digestion was assessed by incubating the siRNAs in rat liver tritosomes. Each siRNA (7 ng/µL final concentration) was placed into a PCR tube containing a cocktail prepared on ice containing 1× catabolic buffer (Xenotech, Catalog #K5200, Lot #18-1-0698), 0.5× rat tritosomes (Xenotech, Catalog #R0610. LT, Lot #1610405), 0.1 U/µL porcine intestinal heparin (Zageno, Catalog #H3149-10KU). An aliquot was removed, an equal volume of 50 mM EDTA was added, and the sample placed at −80° C. This sample was designated as the 0 hr timepoint. The remainder of the reaction was placed in an Eppendorf Mastercycler Gradient and incubated at 37° C. After incubation for 4 and 24 hours, an aliquot was removed from the reaction and stopped by addition of an equal volume of 50 mM EDTA and placed at −80° C. until analysis by gel electrophoresis. All samples were then thawed on ice and 6×DNA Gel Loading Dye (ThermoFisher Catalog #R0611) was added to 1× final concentration. 20 μL of each sample was loaded onto a 20% polyacrylamide TBE gel (ThermoFisher, Catalog #EC63155BOX). Electrophoresis was carried out at a constant 100V for 75 minutes in an XCell SureLock Mini-Cell Electrophoresis System (ThermoFisher) using 1×TBE (Tris/boric/EDTA) (Fisher, Catalog #FERB52) as the tank buffer. The siRNA was visualized by staining the gel with a 1:10,000 dilution of SYBR Gold (ThermoFisher, Catalog #S-11494) in TBE for 15 minutes at room temperature with rocking. The gel was washed with 1×TBE for 15 minutes and then placed on a FotoPrep1 UV transilluminator (Fotodyne). The gel was imaged using the camera app set on MONO on an iPhone 6s with a yellow gel filter (Neewer) placed over the lens. Band intensity was measured using NIH ImageJ using the "Analyze: Gels" function. The remaining siRNA percent was normalized to the value obtained at the 0 hr timepoint for that siRNA. Results are shown in Table 11. By using this assay, we were able to determine that some siRNAs are more resistant to nuclease digestion with more remaining intact over time compared with other siRNAs with the same modification pattern.

TABLE 11

Resistance of ANGPTL7 siRNAs to Nucleases Present in Rat Liver Tritosomes

| siRNA | Timepoint (hr) | % remaining |
|---|---|---|
| ETD00269 | 0 | 100% |
|  | 4 | 109% |
|  | 24 | 69% |
| ETD00270 | 0 | 100% |
|  | 4 | 69% |
|  | 24 | 47% |
| ETD00276 | 0 | 100% |
|  | 4 | 103% |
|  | 24 | 78% |
| ETD00302 | 0 | 100% |
|  | 4 | 68% |
|  | 24 | 26% |
| ETD00353 | 0 | 100% |
|  | 4 | 75% |
|  | 24 | 34% |
| ETD00356 | 0 | 100% |
|  | 4 | 66% |
|  | 24 | 29% |
| ETD00358 | 0 | 100% |
|  | 4 | 89% |
|  | 24 | 48% |
| ETD00382 | 0 | 100% |
|  | 4 | 126% |
|  | 24 | 64% |
| ETD00370 | 0 | 100% |
|  | 4 | 97% |
|  | 24 | 55% |
| ETD00374 | 0 | 100% |
|  | 4 | 54% |
|  | 24 | 2% |
| ETD00377 | 0 | 100% |
|  | 4 | 92% |
|  | 24 | 49% |
| ETD00378 | 0 | 100% |
|  | 4 | 87% |
|  | 24 | 55% |
| ETD00381 | 0 | 100% |
|  | 4 | 54% |
|  | 24 | 5% |

Example 17: siRNA-Mediated Knockdown of ANGPTL7 Expression in Primary Human Trabecular Meshwork Cells in the Presence of Dexamethasone In this experiment, primary human trabecular meshwork cells exposed to dexamethasone were treated with a siRNA targeting ANGPTL7. Primary HTM cells (Cell Applications Catalog #634-05a) were grown to confluency in high-glucose DMEM (Cytiva cat #SH30243.01) supplemented with 10% FBS (Gemini Bio Catalog #900-108) in a water-jacketed, humidified incubator at 37° C. in an atmosphere composed of air plus 5% carbon dioxide. The cells were harvested with Trypsin/EDTA (PromoCell Catalog #C-41010), resuspended in DMEM+10% FBS at a cell density of 200,000 cells/mL, then seeded in 24-well tissue culture plates at 20,000 cells/well. Once the cells reached 80% confluency, the media was replaced and cells were serum starved in DMEM for 24 hrs in a water-jacketed, humidified incubator at 37° C. in an atmosphere composed of air plus 5% carbon dioxide. Next, 5 uL of dexamethasone (Sigma Catalog #D4902-100MG) prepared at 50 uM was added to the wells to give a final concentration of 500 nM and the plates incubated an additional 24 hours. This was designated Day 0. On Day 1, the media was replaced with 0.5 mL DMEM, 0.5 mL DMEM containing 1 uM negative control siRNA (Accell Non-targeting Control siRNA #2, Dharmacon Catalog #D-001910-02-20) or 0.5 mL DMEM containing 1 uM ETD00752 targeting ANGPTL7. The ANGPTL7 siRNA ETD00752 has a TEG-cholesterol moiety attached to the 3' end of the sense strand and is derived from ETD00356. ETD00752 includes the following sequences: sense strand 5' AfsusAfuGfuAfCfCfaAfgGfaUfgUfuAfsusu[Chol-TEG] 3' (SEQ ID NO: 11377), antisense strand 5' usAfsaCfaUfcCfuUfgguAfcAfuAfususu 3' (SEQ ID NO: 11306). On Day 2, Day 4 and Day 6, 5 uL of 50 uM dexamethasone was added to all wells. On Day 3 and Day 5, media was replaced with 0.5 mL of fresh DMEM, 0.5 mL fresh DMEM containing 1 uM negative control siRNA (Accell Non-targeting Control siRNA #2, Dharmacon #D-001910-02-20) or 0.5 mL fresh DMEM containing 1 uM ETD00752 targeting ANGPTL7 in the appropriate wells. Controls also included cells that did not receive siRNA or dexamethsone.

On Day 8, media was collected for quantitation of ANGPTL7 protein by ELISA (RayBio® Human ANGPTL7 ELISA Kit Catalog #ELH-ANGPTL7-1) according to the manufacturer's instructions. Total RNA was harvested from the cells and cDNA prepared using TagMan® Fast Advanced Cells-to-$C_T$™ Kit (ThermoFisher, Catalog #A35374) according to the manufacturer's instructions. The level of ANGPTL7 mRNA from cells in each well was measured in triplicate by real-time qPCR on an Applied Biosystems 7500 Fast Real-Time PCR machine using TaqMan Gene Expression Assay for human ANGPTL7 (ThermoFisher, assay #Hs00221727_m1). The level of PPIA mRNA was measured using TaqMan Gene Expression Assay (ThermoFisher, assay #Hs99999904_m1) and used to determine relative ANGPTL7 mRNA levels from cells in each well using the delta-delta Ct method. All data were normalized to relative ANGPTL7 mRNA levels in cells treated with dexamethasone alone. Results are shown in Table 12. Results indicate primary HTM cells treated with dexamethasone have much higher levels of ANGPTL7 mRNA and ANGPTL7 protein than cells that have not been treated with dexamethasone. In addition, primary HTM cells exposed to dexamethasone and treated with ETD00752 had much lower levels of ANGPTL7 mRNA and ANGPTL7 protein than cells that had not been treated with ETD00752 or had been treated with the Accell Non-targeting Control siRNA #2.

TABLE 12

Induction of ANGPTL7 Expression by Dexamethasone and Knockdown of ANGPTL7 expression by EID00752 in Primary HTM Cells

| siRNA name | Relative ANGPTL7 mRNA | ANGPTL7 Protein (ng/uL) |
|---|---|---|
| Cells with dexamethasone | 1.00 | 15.7 |
| Accell Non-targeting Control siRNA #2 | 0.44 | 8.1 |
| ETD00752 | 0.021 | 1.6 |
| Cells without dexamethasone | 0.027 | 1.9 |

Example 18: siRNA-Mediated Knockdown of ANGPTL7 Expression in a 3D In Vitro Model of Glaucoma In the human eye, homeostatic intraocular pressure (IOP) is maintained by formation and drainage of the aqueous humor, primarily through the human trabecular meshwork (HTM). Approximately, 70-90% of the aqueous humor is drained through this tissue and it is believed that a decrease in outflow through the TM leads to elevated IOP. An in vitro 3D HTM model (3D-HTM™) that recapitulates the biological and physiological characteristics of the HTM has been established by the contract research organization Glauconix. The following study was performed using 3D-HTM™ in order to provide proof of concept of siRNA-mediated knockdown of ANGPTL7 in an in vitro model system of glaucoma.

The 3D-HTM™ constructs were cultured in 10% FBS-IMEM using primary donor trabecular meshwork cells over a two-week period. Once the 3D-HTM™ constructs were ready, they were placed in 6.7% FBS-IMEM for 24 h prior to the treatments. Treatments included the following: On Day 0, media was replaced with fresh 6.7% FBS medium containing 500 nM dexamethasone. On Day 3, the media was replaced with fresh 6.7% FBS medium containing 500 nM dexamethasone. On Day 4, the media was replaced with fresh 6.7% FBS medium without dexamethasone and transfected with siRNA. The siRNAs used in this study were ETD00153, ETD00353 and ETD00356. ETD00153 is an siRNA that does not target ANGPTL7 and functioned as a negative control siRNA ETD00153 has the following sequences: sense strand 5' UfsgsUfgGfcCfCfGfcAfcGfgGfgCfaAfsusu 3' (SEQ ID NO: 11378), antisense strand 5' usUfsgCfcCfcGfuGfcggGfcCfaCfasusu 3' (SEQ ID NO: 11379). ETD00353 and ETD00356 are siRNAs that target ANGPTL7. ETD00353 has the following sequences: sense strand 5' CfsasUfgGfaUfCfUfaCfcUfaCfuCfcAfsusu 3' (SEQ ID NO: 11183), antisense strand 5' usGfsgAfgUfaGfgUfagaUfcCfaUfgsusu 3' (SEQ ID NO: 11303). ETD00356 has the following sequences: sense strand 5' AfsusAfuGfuAfCfCfaAfgGfaUfgUfuAfsusu 3' (SEQ ID NO:11186), antisense strand 5' usAfsaCfaUfcCfuUfgguAfcAfuAfususu 3' (SEQ ID NO: 11306). Transfection was accomplished using Targefect-RAW (Targeting Systems, Catalog #RAW-01). Transfection complexes were prepared on ice. First, 100 nM siRNA from 1001.04 stock was added to 4.5 g/L DMEM without antibiotics and the tubes were flicked 12 times to accomplish mixing. Next, a volume of targetfect that was $\frac{1}{50}^{th}$ of the total volume of the mixture was added to the diluted siRNA and the tubes were flicked 12 times to accomplish mixing. To this a volume of the virofect enhancer reagent that was $\frac{1}{25}^{th}$ of the total volume of the mixture was added. The tubes were flicked 12 times to accomplish mixing. The mixture was then incubated at 37° C. for 25 minutes to allow the formation of the transfection complexes. Complete medium (10% pFBS DMEM with antibiotics) was then added to the transfection complexes at double the volume of the complex. For example, if the volume of the complexes was 0.5 mL, 1 mL of complete medium was added. Next, 225 μL of the complex plus complete medium mixture was added to the appropriate wells. On Day 5, dexamethasone was added to 500 nM without changing the media. On Day 6, the media was replaced with fresh media containing 6.7% FBS without dexamethasone and the wells receiving siRNA were transfected a second time using the protocol for the first transfection described above. On Day 7, dexamethasone was added to 500 nM without changing the media.

On Day 8, Total RNA was harvested from the cells using the RNAeasy Plus Mini kit (Qiagen, Catalog #74134) according to the manufacturer's instructions. The cDNA was prepared from 500 ng of total RNA using the Maxima first strand synthesis kit (ThermoFisher Catalog #K1642) according to the manufacturer's instructions. The level of ANGPTL7 mRNA from cells in each well was measured in triplicate by real-time qPCR on an Applied Biosystems 7500 Fast Real-Time PCR machine using TaqMan Gene Expression Assay for human ANGPTL7 (ThermoFisher, assay #Hs00221727_m1). The level of PPIA mRNA was measured using TaqMan Gene Expression Assay (ThermoFisher, assay #Hs99999904 m1) and used to determine relative ANGPTL7 mRNA levels from cells in each well using the delta-delta Ct method. All data were normalized to relative ANGPTL7 mRNA levels in cells treated with dexamethasone alone. Results are shown in Table 13. Results indicate 3D-HTM™ cells exposed to dexamethasone and transfected with siRNAs ETD00353 or ETD00356 had much lower levels of ANGPTL7 mRNA than 3D-HTM™ cells not receiving siRNA or those that had been transfected with the negative control siRNA ETD00153.

TABLE 13 siRNA-mediated Knockdown of ANGPTL7 expression in 3D-HTMTM cells

| siRNA name | Relative ANGPTL7 mRNA |
|---|---|
| 3D-HTM ™ cells with dexamethasone | 1.00 |
| ETD00153 | 0.95 |
| ETD00353 | 0.54 |
| ETD00356 | 0.31 |

Sequence Information

Some embodiments include one or more nucleic acid sequences from the non-limiting examples in the following table:

TABLE 14

Sequences

| SEQ ID NO: | Description |
|---|---|
| 1-4412 | ANGPTL7 siRNA oligonucleotide sequences |
| 4413-11084 | ANGPTL7 antisense oligonucleotide sequences |
| 11085 | Full-length ANGPTL7 human mRNA (GenBank Acc. # NM_021146.4) |
| 11086 | Full-length ANGPTL7 human pre-mRNA (NC_000001.11 (11189289 . . . 11195981) |
| 11087 | Antisense oligonucleotide targeting ANGPTL7 (e.g. human, NHP, mouse, rat, dog) |
| 11088 | Non-targeting control antisense oligonucleotide |
| 11089 | Sense strand oligonucleotide targeting ANGPTL7 (e.g. human, NHP, mouse, rat, dog) |
| 11090 | Antisense strand oligonucleotide targeting ANGPTL7 (e.g. human, NHP, mouse, rat, dog) |
| 11091 | Sense strand non-targeting (control) oligonucleotide |
| 11092 | Antisense strand non-targeting (control) oligonucleotide |
| 11093-11332 | Modified human ANGPT7 siRNA sequences |

TABLE 14-continued

Sequences

| SEQ ID NO: | Description |
|---|---|
| 11333-11376 | Modified human ANGPT7 siRNA sequences that are cross-reactive with mouse |
| 11377 | ETD00752 sense strand |
| 11378 | ETD00153 sense strand |
| 11379 | ETD00153 antisense strand |
| 11380 | ASO modification pattern |
| 11381 | Modification pattern 1S |
| 11382 | Modification pattern 2S |
| 11383 | Modification pattern 3S |
| 11384 | Modification pattern 4S |
| 11385 | Modification pattern 5S |
| 11386 | Modification pattern 1AS |
| 11387 | Modification pattern 2AS |
| 11388 | Modification pattern 3AS |
| 11389 | Modification pattern 4AS |
| 11390-11393 | Peptide moieties |

SEQUENCE LISTING (11393 sequences)

SEQ ID NO: 1 - RNA, 19 nt, Artificial Sequence
  Description of Artificial Sequence: Synthetic oligonucleotide
gggcuuggaaggaaagcua

SEQ ID NO: 2 - RNA, 19 nt, Artificial Sequence
  Description of Artificial Sequence: Synthetic oligonucleotide
ggcuuggaaggaaagcuau

SEQ ID NO: 3 - RNA, 19 nt, Artificial Sequence
  Description of Artificial Sequence: Synthetic oligonucleotide
gcuuggaaggaaagcuaua

SEQ ID NO: 4 - RNA, 19 nt, Artificial Sequence
  Description of Artificial Sequence: Synthetic oligonucleotide
cuuggaaggaaagcuauag

SEQ ID NO: 5 - RNA, 19 nt, Artificial Sequence
  Description of Artificial Sequence: Synthetic oligonucleotide
uuggaaggaaagcuauagg

SEQ ID NO: 6 - RNA, 19 nt, Artificial Sequence
  Description of Artificial Sequence: Synthetic oligonucleotide
uggaaggaaagcuauaggc

SEQ ID NO: 7 - RNA, 19 nt, Artificial Sequence
  Description of Artificial Sequence: Synthetic oligonucleotide
ggaaggaaagcuauaggcu

SEQ ID NO: 8 - RNA, 19 nt, Artificial Sequence
  Description of Artificial Sequence: Synthetic oligonucleotide
gaaggaaagcuauaggcua

SEQ ID NO: 9 - RNA, 19 nt, Artificial Sequence
  Description of Artificial Sequence: Synthetic oligonucleotide
aaggaaagcuauaggcuac

SEQ ID NO: 10 - RNA, 19 nt, Artificial Sequence
  Description of Artificial Sequence: Synthetic oligonucleotide
aggaaagcuauaggcuacc

SEQ ID NO: 11 - RNA, 19 nt, Artificial Sequence
  Description of Artificial Sequence: Synthetic oligonucleotide
ggaaagcuauaggcuaccc

SEQ ID NO: 12 - RNA, 19 nt, Artificial Sequence
  Description of Artificial Sequence: Synthetic oligonucleotide
gaaagcuauaggcuaccca

SEQ ID NO: 13 - RNA, 19 nt, Artificial Sequence
  Description of Artificial Sequence: Synthetic oligonucleotide
aaagcuauaggcuacccau

SEQ ID NO: 14 - RNA, 19 nt, Artificial Sequence
  Description of Artificial Sequence: Synthetic oligonucleotide
aagcuauaggcuacccauu

SEQ ID NO: 15 - RNA, 19 nt, Artificial Sequence
  Description of Artificial Sequence: Synthetic oligonucleotide
agcuauaggcuacccauuc

SEQ ID NO: 16 - RNA, 19 nt, Artificial Sequence
  Description of Artificial Sequence: Synthetic oligonucleotide
gcuauaggcuacccauuca

SEQ ID NO: 17 - RNA, 19 nt, Artificial Sequence
  Description of Artificial Sequence: Synthetic oligonucleotide
cuauaggcuacccauucag

SEQ ID NO: 18 - RNA, 19 nt, Artificial Sequence
  Description of Artificial Sequence: Synthetic oligonucleotide
uauaggcuacccauucagc

SEQ ID NO: 19 - RNA, 19 nt, Artificial Sequence
  Description of Artificial Sequence: Synthetic oligonucleotide
auaggcuacccauucagcu

SEQ ID NO: 20 - RNA, 19 nt, Artificial Sequence
  Description of Artificial Sequence: Synthetic oligonucleotide
uaggcuacccauucagcuc

SEQ ID NO: 21 - RNA, 19 nt, Artificial Sequence
  Description of Artificial Sequence: Synthetic oligonucleotide
aggcuacccauucagcucc

SEQ ID NO: 22 - RNA, 19 nt, Artificial Sequence
  Description of Artificial Sequence: Synthetic oligonucleotide
ggcuacccauucagcuccc

SEQ ID NO: 23 - RNA, 19 nt, Artificial Sequence
  Description of Artificial Sequence: Synthetic oligonucleotide
gcuacccauucagcucccc

SEQ ID NO: 24 - RNA, 19 nt, Artificial Sequence
  Description of Artificial Sequence: Synthetic oligonucleotide
cuacccauucagcuccccu

SEQ ID NO: 25 - RNA, 19 nt, Artificial Sequence
  Description of Artificial Sequence: Synthetic oligonucleotide
uacccauucagcuccccug

SEQ ID NO: 26 - RNA, 19 nt, Artificial Sequence
  Description of Artificial Sequence: Synthetic oligonucleotide
acccauucagcuccccugu

SEQ ID NO: 27 - RNA, 19 nt, Artificial Sequence
  Description of Artificial Sequence: Synthetic oligonucleotide
cccauucagcuccccuguc

SEQ ID NO: 28 - RNA, 19 nt, Artificial Sequence
  Description of Artificial Sequence: Synthetic oligonucleotide
ccauucagcuccccuguca

SEQ ID NO: 29 - RNA, 19 nt, Artificial Sequence
  Description of Artificial Sequence: Synthetic oligonucleotide
cauucagcuccccugucag

SEQ ID NO: 30 - RNA, 19 nt, Artificial Sequence
  Description of Artificial Sequence: Synthetic oligonucleotide
auucagcuccccugucaga

SEQ ID NO: 31 - RNA, 19 nt, Artificial Sequence
  Description of Artificial Sequence: Synthetic oligonucleotide
uucagcuccccugucagag

SEQ ID NO: 32 - RNA, 19 nt, Artificial Sequence
  Description of Artificial Sequence: Synthetic oligonucleotide
ucagcuccccugucagaga

SEQ ID NO: 33 - RNA, 19 nt, Artificial Sequence
  Description of Artificial Sequence: Synthetic oligonucleotide
cagcuccccugucagagac

SEQ ID NO: 34 - RNA, 19 nt, Artificial Sequence
  Description of Artificial Sequence: Synthetic oligonucleotide
agcuccccugucagagacu

SEQ ID NO: 35 - RNA, 19 nt, Artificial Sequence
  Description of Artificial Sequence: Synthetic oligonucleotide
gcuccccugucagagacuc

SEQ ID NO: 36 - RNA, 19 nt, Artificial Sequence
  Description of Artificial Sequence: Synthetic oligonucleotide
cuccccugucagagacuca

SEQ ID NO: 37 - RNA, 19 nt, Artificial Sequence
  Description of Artificial Sequence: Synthetic oligonucleotide
uccccugucagagacucaa

SEQ ID NO: 38 - RNA, 19 nt, Artificial Sequence
  Description of Artificial Sequence: Synthetic oligonucleotide
ccccugucagagacucaag

SEQ ID NO: 39 - RNA, 19 nt, Artificial Sequence
  Description of Artificial Sequence: Synthetic oligonucleotide
cccugucagagacucaagc

SEQ ID NO: 40 - RNA, 19 nt, Artificial Sequence
  Description of Artificial Sequence: Synthetic oligonucleotide
ccugucagagacucaagcu

SEQ ID NO: 41 - RNA, 19 nt, Artificial Sequence
  Description of Artificial Sequence: Synthetic oligonucleotide
cugucagagacucaagcuu

SEQ ID NO: 42 - RNA, 19 nt, Artificial Sequence
  Description of Artificial Sequence: Synthetic oligonucleotide
ugucagagacucaagcuuu

SEQ ID NO: 43 - RNA, 19 nt, Artificial Sequence
  Description of Artificial Sequence: Synthetic oligonucleotide
gucagagacucaagcuuug

SEQ ID NO: 44 - RNA, 19 nt, Artificial Sequence
  Description of Artificial Sequence: Synthetic oligonucleotide
ucagagacucaagcuuuga

SEQ ID NO: 45 - RNA, 19 nt, Artificial Sequence
  Description of Artificial Sequence: Synthetic oligonucleotide
cagagacucaagcuuugag

SEQ ID NO: 46 - RNA, 19 nt, Artificial Sequence
  Description of Artificial Sequence: Synthetic oligonucleotide
agagacucaagcuuugaga

SEQ ID NO: 47 - RNA, 19 nt, Artificial Sequence
  Description of Artificial Sequence: Synthetic oligonucleotide
gagacucaagcuuugagaa

SEQ ID NO: 48 - RNA, 19 nt, Artificial Sequence
  Description of Artificial Sequence: Synthetic oligonucleotide
agacucaagcuuugagaaa

SEQ ID NO: 49 - RNA, 19 nt, Artificial Sequence
  Description of Artificial Sequence: Synthetic oligonucleotide
gacucaagcuuugagaaag

SEQ ID NO: 50 - RNA, 19 nt, Artificial Sequence
  Description of Artificial Sequence: Synthetic oligonucleotide
acucaagcuuugagaaagg

SEQ ID NO: 51 - RNA, 19 nt, Artificial Sequence
  Description of Artificial Sequence: Synthetic oligonucleotide
cucaagcuuugagaaaggc

SEQ ID NO: 52 - RNA, 19 nt, Artificial Sequence
  Description of Artificial Sequence: Synthetic oligonucleotide
ucaagcuuugagaaaggcu

SEQ ID NO: 53 - RNA, 19 nt, Artificial Sequence
  Description of Artificial Sequence: Synthetic oligonucleotide
caagcuuugagaaaggcua

SEQ ID NO: 54 - RNA, 19 nt, Artificial Sequence
  Description of Artificial Sequence: Synthetic oligonucleotide
aagcuuugagaaaggcuag

SEQ ID NO: 55 - RNA, 19 nt, Artificial Sequence
  Description of Artificial Sequence: Synthetic oligonucleotide
agcuuugagaaaggcuagc

SEQ ID NO: 56 - RNA, 19 nt, Artificial Sequence
  Description of Artificial Sequence: Synthetic oligonucleotide
gcuuugagaaaggcuagca

SEQ ID NO: 57 - RNA, 19 nt, Artificial Sequence
  Description of Artificial Sequence: Synthetic oligonucleotide
cuuugagaaaggcuagcaa

SEQ ID NO: 58 - RNA, 19 nt, Artificial Sequence
  Description of Artificial Sequence: Synthetic oligonucleotide
uuugagaaaggcuagcaaa

SEQ ID NO: 59 - RNA, 19 nt, Artificial Sequence
  Description of Artificial Sequence: Synthetic oligonucleotide
uugagaaaggcuagcaaag

SEQ ID NO: 60 - RNA, 19 nt, Artificial Sequence
  Description of Artificial Sequence: Synthetic oligonucleotide
ugagaaaggcuagcaaaga

SEQ ID NO: 61 - RNA, 19 nt, Artificial Sequence
  Description of Artificial Sequence: Synthetic oligonucleotide
gagaaaggcuagcaaagag

SEQ ID NO: 62 - RNA, 19 nt, Artificial Sequence
  Description of Artificial Sequence: Synthetic oligonucleotide
agaaaggcuagcaaagagc

SEQ ID NO: 63 - RNA, 19 nt, Artificial Sequence
  Description of Artificial Sequence: Synthetic oligonucleotide
gaaaggcuagcaaagagca

SEQ ID NO: 64 - RNA, 19 nt, Artificial Sequence
  Description of Artificial Sequence: Synthetic oligonucleotide
aaaggcuagcaaagagcaa

SEQ ID NO: 65 - RNA, 19 nt, Artificial Sequence
  Description of Artificial Sequence: Synthetic oligonucleotide
aaggcuagcaaagagcaag

SEQ ID NO: 66 - RNA, 19 nt, Artificial Sequence
  Description of Artificial Sequence: Synthetic oligonucleotide
aggcuagcaaagagcaagg

SEQ ID NO: 67 - RNA, 19 nt, Artificial Sequence
  Description of Artificial Sequence: Synthetic oligonucleotide
ggcuagcaaagagcaagga

SEQ ID NO: 68 - RNA, 19 nt, Artificial Sequence
  Description of Artificial Sequence: Synthetic oligonucleotide
gcuagcaaagagcaaggaa

SEQ ID NO: 69 - RNA, 19 nt, Artificial Sequence
  Description of Artificial Sequence: Synthetic oligonucleotide
cuagcaaagagcaaggaaa

SEQ ID NO: 70 - RNA, 19 nt, Artificial Sequence
  Description of Artificial Sequence: Synthetic oligonucleotide
uagcaaagagcaaggaaag

SEQ ID NO: 71 - RNA, 19 nt, Artificial Sequence
  Description of Artificial Sequence: Synthetic oligonucleotide
agcaaagagcaaggaaaga

SEQ ID NO: 72 - RNA, 19 nt, Artificial Sequence
  Description of Artificial Sequence: Synthetic oligonucleotide
gcaaagagcaaggaaagag

SEQ ID NO: 73 - RNA, 19 nt, Artificial Sequence
  Description of Artificial Sequence: Synthetic oligonucleotide
caaagagcaaggaaagaga

SEQ ID NO: 74 - RNA, 19 nt, Artificial Sequence
  Description of Artificial Sequence: Synthetic oligonucleotide
aaagagcaaggaaagagag

SEQ ID NO: 75 - RNA, 19 nt, Artificial Sequence
  Description of Artificial Sequence: Synthetic oligonucleotide
aagagcaaggaaagagaga

SEQ ID NO: 76 - RNA, 19 nt, Artificial Sequence
  Description of Artificial Sequence: Synthetic oligonucleotide
agagcaaggaaagagagaa

SEQ ID NO: 77 - RNA, 19 nt, Artificial Sequence
  Description of Artificial Sequence: Synthetic oligonucleotide
gagcaaggaaagagagaaa

SEQ ID NO: 78 - RNA, 19 nt, Artificial Sequence
  Description of Artificial Sequence: Synthetic oligonucleotide
agcaaggaaagagagaaaa

SEQ ID NO: 79 - RNA, 19 nt, Artificial Sequence
  Description of Artificial Sequence: Synthetic oligonucleotide
gcaaggaaagagagaaaac

SEQ ID NO: 80 - RNA, 19 nt, Artificial Sequence
  Description of Artificial Sequence: Synthetic oligonucleotide
caaggaaagagagaaaaca

SEQ ID NO: 81 - RNA, 19 nt, Artificial Sequence
  Description of Artificial Sequence: Synthetic oligonucleotide
aaggaaagagagaaaacaa

SEQ ID NO: 82 - RNA, 19 nt, Artificial Sequence
  Description of Artificial Sequence: Synthetic oligonucleotide
aggaaagagagaaaacaac

SEQ ID NO: 83 - RNA, 19 nt, Artificial Sequence
  Description of Artificial Sequence: Synthetic oligonucleotide
ggaaagagagaaaacaaca

SEQ ID NO: 84 - RNA, 19 nt, Artificial Sequence
  Description of Artificial Sequence: Synthetic oligonucleotide
gaaagagagaaaacaacaa

SEQ ID NO: 85 - RNA, 19 nt, Artificial Sequence
  Description of Artificial Sequence: Synthetic oligonucleotide
aaagagagaaaacaacaaa

SEQ ID NO: 86 - RNA, 19 nt, Artificial Sequence
  Description of Artificial Sequence: Synthetic oligonucleotide
aagagagaaaacaacaaag

SEQ ID NO: 87 - RNA, 19 nt, Artificial Sequence
  Description of Artificial Sequence: Synthetic oligonucleotide
agagagaaaacaacaaagu

SEQ ID NO: 88 - RNA, 19 nt, Artificial Sequence
  Description of Artificial Sequence: Synthetic oligonucleotide
gagagaaaacaacaaagug

SEQ ID NO: 89 - RNA, 19 nt, Artificial Sequence
  Description of Artificial Sequence: Synthetic oligonucleotide
agagaaaacaacaaagugg

SEQ ID NO: 90 - RNA, 19 nt, Artificial Sequence
  Description of Artificial Sequence: Synthetic oligonucleotide
gagaaaacaacaaaguggc

SEQ ID NO: 91 - RNA, 19 nt, Artificial Sequence
  Description of Artificial Sequence: Synthetic oligonucleotide
agaaaacaacaaaguggcg

SEQ ID NO: 92 - RNA, 19 nt, Artificial Sequence
  Description of Artificial Sequence: Synthetic oligonucleotide
gaaaacaacaaaguggcga

SEQ ID NO: 93 - RNA, 19 nt, Artificial Sequence
  Description of Artificial Sequence: Synthetic oligonucleotide
aaaacaacaaaguggcgag

SEQ ID NO: 94 - RNA, 19 nt, Artificial Sequence
  Description of Artificial Sequence: Synthetic oligonucleotide
aaacaacaaaguggcgagg

SEQ ID NO: 95 - RNA, 19 nt, Artificial Sequence
  Description of Artificial Sequence: Synthetic oligonucleotide
aacaacaaaguggcgaggc

SEQ ID NO: 96 - RNA, 19 nt, Artificial Sequence
  Description of Artificial Sequence: Synthetic oligonucleotide
acaacaaaguggcgaggcc

SEQ ID NO: 97 - RNA, 19 nt, Artificial Sequence
  Description of Artificial Sequence: Synthetic oligonucleotide
caacaaaguggcgaggccc

SEQ ID NO: 98 - RNA, 19 nt, Artificial Sequence
  Description of Artificial Sequence: Synthetic oligonucleotide
aacaaaguggcgaggcccu

SEQ ID NO: 99 - RNA, 19 nt, Artificial Sequence
  Description of Artificial Sequence: Synthetic oligonucleotide
acaaaguggcgaggcccuc

SEQ ID NO: 100 - RNA, 19 nt, Artificial Sequence
  Description of Artificial Sequence: Synthetic oligonucleotide
caaaguggcgaggcccuca

SEQ ID NO: 101 - RNA, 19 nt, Artificial Sequence
  Description of Artificial Sequence: Synthetic oligonucleotide
aaaguggcgaggcccucag

SEQ ID NO: 102 - RNA, 19 nt, Artificial Sequence
  Description of Artificial Sequence: Synthetic oligonucleotide
aaguggcgaggcccucaga

SEQ ID NO: 103 - RNA, 19 nt, Artificial Sequence
  Description of Artificial Sequence: Synthetic oligonucleotide
aguggcgaggcccucagag

SEQ ID NO: 104 - RNA, 19 nt, Artificial Sequence
  Description of Artificial Sequence: Synthetic oligonucleotide
guggcgaggcccucagagu

SEQ ID NO: 105 - RNA, 19 nt, Artificial Sequence
  Description of Artificial Sequence: Synthetic oligonucleotide
uggcgaggcccucagagug

SEQ ID NO: 106 - RNA, 19 nt, Artificial Sequence
  Description of Artificial Sequence: Synthetic oligonucleotide
ggcgaggcccucagaguga

SEQ ID NO: 107 - RNA, 19 nt, Artificial Sequence
  Description of Artificial Sequence: Synthetic oligonucleotide
gcgaggcccucagagugaa

SEQ ID NO: 108 - RNA, 19 nt, Artificial Sequence
  Description of Artificial Sequence: Synthetic oligonucleotide
cgaggcccucagagugaaa

SEQ ID NO: 109 - RNA, 19 nt, Artificial Sequence
  Description of Artificial Sequence: Synthetic oligonucleotide
gaggcccucagagugaaag

SEQ ID NO: 110 - RNA, 19 nt, Artificial Sequence
  Description of Artificial Sequence: Synthetic oligonucleotide
aggcccucagagugaaagc

SEQ ID NO: 111 - RNA, 19 nt, Artificial Sequence
  Description of Artificial Sequence: Synthetic oligonucleotide
ggcccucagagugaaagcg

SEQ ID NO: 112 - RNA, 19 nt, Artificial Sequence
  Description of Artificial Sequence: Synthetic oligonucleotide
gcccucagagugaaagcgu

SEQ ID NO: 113 - RNA, 19 nt, Artificial Sequence
  Description of Artificial Sequence: Synthetic oligonucleotide
cccucagagugaaagcgua

SEQ ID NO: 114 - RNA, 19 nt, Artificial Sequence
  Description of Artificial Sequence: Synthetic oligonucleotide
ccucagagugaaagcguaa

SEQ ID NO: 115 - RNA, 19 nt, Artificial Sequence
  Description of Artificial Sequence: Synthetic oligonucleotide
cucagagugaaagcguaag

SEQ ID NO: 116 - RNA, 19 nt, Artificial Sequence
  Description of Artificial Sequence: Synthetic oligonucleotide
ucagagugaaagcguaagg

SEQ ID NO: 117 - RNA, 19 nt, Artificial Sequence
  Description of Artificial Sequence: Synthetic oligonucleotide
cagagugaaagcguaaggu

SEQ ID NO: 118 - RNA, 19 nt, Artificial Sequence
  Description of Artificial Sequence: Synthetic oligonucleotide
agagugaaagcguaagguu

SEQ ID NO: 119 - RNA, 19 nt, Artificial Sequence
  Description of Artificial Sequence: Synthetic oligonucleotide
gagugaaagcguaagguuc

SEQ ID NO: 120 - RNA, 19 nt, Artificial Sequence
  Description of Artificial Sequence: Synthetic oligonucleotide
agugaaagcguaagguuca

SEQ ID NO: 121 - RNA, 19 nt, Artificial Sequence
  Description of Artificial Sequence: Synthetic oligonucleotide
gugaaagcguaagguucag

SEQ ID NO: 122 - RNA, 19 nt, Artificial Sequence
  Description of Artificial Sequence: Synthetic oligonucleotide
ugaaagcguaagguucagu

SEQ ID NO: 123 - RNA, 19 nt, Artificial Sequence
  Description of Artificial Sequence: Synthetic oligonucleotide
gaaagcguaagguucaguc

SEQ ID NO: 124 - RNA, 19 nt, Artificial Sequence
  Description of Artificial Sequence: Synthetic oligonucleotide
aaagcguaagguucaguca

SEQ ID NO: 125 - RNA, 19 nt, Artificial Sequence
  Description of Artificial Sequence: Synthetic oligonucleotide
aagcguaagguucagucag

SEQ ID NO: 126 - RNA, 19 nt, Artificial Sequence
  Description of Artificial Sequence: Synthetic oligonucleotide
agcguaagguucagucagc

SEQ ID NO: 127 - RNA, 19 nt, Artificial Sequence
  Description of Artificial Sequence: Synthetic oligonucleotide
gcguaagguucagucagcc

SEQ ID NO: 128 - RNA, 19 nt, Artificial Sequence
  Description of Artificial Sequence: Synthetic oligonucleotide
cguaagguucagucagccu

SEQ ID NO: 129 - RNA, 19 nt, Artificial Sequence
  Description of Artificial Sequence: Synthetic oligonucleotide
guaagguucagucagccug

SEQ ID NO: 130 - RNA, 19 nt, Artificial Sequence
  Description of Artificial Sequence: Synthetic oligonucleotide
uaagguucagucagccugc

SEQ ID NO: 131 - RNA, 19 nt, Artificial Sequence
  Description of Artificial Sequence: Synthetic oligonucleotide
aagguucagucagccugcu

SEQ ID NO: 132 - RNA, 19 nt, Artificial Sequence
  Description of Artificial Sequence: Synthetic oligonucleotide
agguucagucagccugcug

SEQ ID NO: 133 - RNA, 19 nt, Artificial Sequence
  Description of Artificial Sequence: Synthetic oligonucleotide
gguucagucagccugcugc

SEQ ID NO: 134 - RNA, 19 nt, Artificial Sequence
  Description of Artificial Sequence: Synthetic oligonucleotide
guucagucagccugcugca

SEQ ID NO: 135 - RNA, 19 nt, Artificial Sequence
  Description of Artificial Sequence: Synthetic oligonucleotide
uucagucagccugcugcag

SEQ ID NO: 136 - RNA, 19 nt, Artificial Sequence
  Description of Artificial Sequence: Synthetic oligonucleotide
ucagucagccugcugcagc

SEQ ID NO: 137 - RNA, 19 nt, Artificial Sequence
  Description of Artificial Sequence: Synthetic oligonucleotide
cagucagccugcugcagcu

SEQ ID NO: 138 - RNA, 19 nt, Artificial Sequence
  Description of Artificial Sequence: Synthetic oligonucleotide
agucagccugcugcagcuu

SEQ ID NO: 139 - RNA, 19 nt, Artificial Sequence
  Description of Artificial Sequence: Synthetic oligonucleotide
gucagccugcugcagcuuu

SEQ ID NO: 140 - RNA, 19 nt, Artificial Sequence
  Description of Artificial Sequence: Synthetic oligonucleotide
ucagccugcugcagcuuug

SEQ ID NO: 141 - RNA, 19 nt, Artificial Sequence
  Description of Artificial Sequence: Synthetic oligonucleotide
cagccugcugcagcuuugc

SEQ ID NO: 142 - RNA, 19 nt, Artificial Sequence
  Description of Artificial Sequence: Synthetic oligonucleotide
agccugcugcagcuuugca

SEQ ID NO: 143 - RNA, 19 nt, Artificial Sequence
  Description of Artificial Sequence: Synthetic oligonucleotide
gccugcugcagcuuugcag

SEQ ID NO: 144 - RNA, 19 nt, Artificial Sequence
  Description of Artificial Sequence: Synthetic oligonucleotide
ccugcugcagcuuugcaga

SEQ ID NO: 145 - RNA, 19 nt, Artificial Sequence
  Description of Artificial Sequence: Synthetic oligonucleotide
cugcugcagcuuugcagac

SEQ ID NO: 146 - RNA, 19 nt, Artificial Sequence
  Description of Artificial Sequence: Synthetic oligonucleotide
ugcugcagcuuugcagacc

SEQ ID NO: 147 - RNA, 19 nt, Artificial Sequence
  Description of Artificial Sequence: Synthetic oligonucleotide
gcugcagcuuugcagaccu

SEQ ID NO: 148 - RNA, 19 nt, Artificial Sequence
  Description of Artificial Sequence: Synthetic oligonucleotide
cugcagcuuugcagaccuc

SEQ ID NO: 149 - RNA, 19 nt, Artificial Sequence
  Description of Artificial Sequence: Synthetic oligonucleotide
ugcagcuuugcagaccuca

SEQ ID NO: 150 - RNA, 19 nt, Artificial Sequence
  Description of Artificial Sequence: Synthetic oligonucleotide
gcagcuuugcagaccucag

SEQ ID NO: 151 - RNA, 19 nt, Artificial Sequence
  Description of Artificial Sequence: Synthetic oligonucleotide
cagcuuugcagaccucagc

SEQ ID NO: 152 - RNA, 19 nt, Artificial Sequence
  Description of Artificial Sequence: Synthetic oligonucleotide
agcuuugcagaccucagcu

SEQ ID NO: 153 - RNA, 19 nt, Artificial Sequence
  Description of Artificial Sequence: Synthetic oligonucleotide
gcuuugcagaccucagcug

SEQ ID NO: 154 - RNA, 19 nt, Artificial Sequence
  Description of Artificial Sequence: Synthetic oligonucleotide
cuuugcagaccucagcugg

SEQ ID NO: 155 - RNA, 19 nt, Artificial Sequence
  Description of Artificial Sequence: Synthetic oligonucleotide
uuugcagaccucagcuggg

SEQ ID NO: 156 - RNA, 19 nt, Artificial Sequence
  Description of Artificial Sequence: Synthetic oligonucleotide
uugcagaccucagcugggc

SEQ ID NO: 157 - RNA, 19 nt, Artificial Sequence
  Description of Artificial Sequence: Synthetic oligonucleotide
ugcagaccucagcugggca

SEQ ID NO: 158 - RNA, 19 nt, Artificial Sequence
  Description of Artificial Sequence: Synthetic oligonucleotide
gcagaccucagcugggcau

SEQ ID NO: 159 - RNA, 19 nt, Artificial Sequence
  Description of Artificial Sequence: Synthetic oligonucleotide
cagaccucagcugggcauc

SEQ ID NO: 160 - RNA, 19 nt, Artificial Sequence
  Description of Artificial Sequence: Synthetic oligonucleotide
agaccucagcugggcaucu

SEQ ID NO: 161 - RNA, 19 nt, Artificial Sequence
  Description of Artificial Sequence: Synthetic oligonucleotide
gaccucagcugggcaucuc

SEQ ID NO: 162 - RNA, 19 nt, Artificial Sequence
  Description of Artificial Sequence: Synthetic oligonucleotide
accucagcugggcaucucc

SEQ ID NO: 163 - RNA, 19 nt, Artificial Sequence
  Description of Artificial Sequence: Synthetic oligonucleotide
ccucagcugggcaucucca

SEQ ID NO: 164 - RNA, 19 nt, Artificial Sequence
  Description of Artificial Sequence: Synthetic oligonucleotide
cucagcugggcaucuccag

SEQ ID NO: 165 - RNA, 19 nt, Artificial Sequence
  Description of Artificial Sequence: Synthetic oligonucleotide
ucagcugggcaucuccaga

SEQ ID NO: 166 - RNA, 19 nt, Artificial Sequence
  Description of Artificial Sequence: Synthetic oligonucleotide
cagcugggcaucuccagac

SEQ ID NO: 167 - RNA, 19 nt, Artificial Sequence
  Description of Artificial Sequence: Synthetic oligonucleotide
agcugggcaucuccagacu

SEQ ID NO: 168 - RNA, 19 nt, Artificial Sequence
  Description of Artificial Sequence: Synthetic oligonucleotide
gcugggcaucuccagacuc

SEQ ID NO: 169 - RNA, 19 nt, Artificial Sequence
  Description of Artificial Sequence: Synthetic oligonucleotide
cugggcaucuccagacucc

SEQ ID NO: 170 - RNA, 19 nt, Artificial Sequence
  Description of Artificial Sequence: Synthetic oligonucleotide
ugggcaucuccagacuccc

SEQ ID NO: 171 - RNA, 19 nt, Artificial Sequence
  Description of Artificial Sequence: Synthetic oligonucleotide
gggcaucuccagacucccc

SEQ ID NO: 172 - RNA, 19 nt, Artificial Sequence
  Description of Artificial Sequence: Synthetic oligonucleotide
ggcaucuccagacuccccu

SEQ ID NO: 173 - RNA, 19 nt, Artificial Sequence
  Description of Artificial Sequence: Synthetic oligonucleotide
gcaucuccagacuccccug

SEQ ID NO: 174 - RNA, 19 nt, Artificial Sequence
  Description of Artificial Sequence: Synthetic oligonucleotide
caucuccagacuccccuga

SEQ ID NO: 175 - RNA, 19 nt, Artificial Sequence
  Description of Artificial Sequence: Synthetic oligonucleotide
aucuccagacuccccugaa

SEQ ID NO: 176 - RNA, 19 nt, Artificial Sequence
  Description of Artificial Sequence: Synthetic oligonucleotide
ucuccagacuccccugaag

SEQ ID NO: 177 - RNA, 19 nt, Artificial Sequence
  Description of Artificial Sequence: Synthetic oligonucleotide
cuccagacuccccugaagg

SEQ ID NO: 178 - RNA, 19 nt, Artificial Sequence
  Description of Artificial Sequence: Synthetic oligonucleotide
uccagacuccccugaagga

SEQ ID NO: 179 - RNA, 19 nt, Artificial Sequence
  Description of Artificial Sequence: Synthetic oligonucleotide
ccagacuccccugaaggaa

SEQ ID NO: 180 - RNA, 19 nt, Artificial Sequence
  Description of Artificial Sequence: Synthetic oligonucleotide
cagacuccccugaaggaag

SEQ ID NO: 181 - RNA, 19 nt, Artificial Sequence
  Description of Artificial Sequence: Synthetic oligonucleotide
agacuccccugaaggaaga

SEQ ID NO: 182 - RNA, 19 nt, Artificial Sequence
  Description of Artificial Sequence: Synthetic oligonucleotide
gacuccccugaaggaagag

SEQ ID NO: 183 - RNA, 19 nt, Artificial Sequence
  Description of Artificial Sequence: Synthetic oligonucleotide
acuccccugaaggaagagc

SEQ ID NO: 184 - RNA, 19 nt, Artificial Sequence
  Description of Artificial Sequence: Synthetic oligonucleotide
cuccccugaaggaagagcc

SEQ ID NO: 185 - RNA, 19 nt, Artificial Sequence
  Description of Artificial Sequence: Synthetic oligonucleotide
uccccugaaggaagagccu

SEQ ID NO: 186 - RNA, 19 nt, Artificial Sequence
  Description of Artificial Sequence: Synthetic oligonucleotide
ccccugaaggaagagccuu

SEQ ID NO: 187 - RNA, 19 nt, Artificial Sequence
  Description of Artificial Sequence: Synthetic oligonucleotide
cccugaaggaagagccuuc

SEQ ID NO: 188 - RNA, 19 nt, Artificial Sequence
  Description of Artificial Sequence: Synthetic oligonucleotide
ccugaaggaagagccuucc

SEQ ID NO: 189 - RNA, 19 nt, Artificial Sequence
  Description of Artificial Sequence: Synthetic oligonucleotide
cugaaggaagagccuuccu

SEQ ID NO: 190 - RNA, 19 nt, Artificial Sequence
  Description of Artificial Sequence: Synthetic oligonucleotide
ugaaggaagagccuuccuc

SEQ ID NO: 191 - RNA, 19 nt, Artificial Sequence
  Description of Artificial Sequence: Synthetic oligonucleotide
gaaggaagagccuuccuca

SEQ ID NO: 192 - RNA, 19 nt, Artificial Sequence
  Description of Artificial Sequence: Synthetic oligonucleotide
aaggaagagccuuccucac

SEQ ID NO: 193 - RNA, 19 nt, Artificial Sequence
  Description of Artificial Sequence: Synthetic oligonucleotide
aggaagagccuuccucacc

SEQ ID NO: 194 - RNA, 19 nt, Artificial Sequence
  Description of Artificial Sequence: Synthetic oligonucleotide
ggaagagccuuccucaccc

SEQ ID NO: 195 - RNA, 19 nt, Artificial Sequence
  Description of Artificial Sequence: Synthetic oligonucleotide
gaagagccuuccucaccca

SEQ ID NO: 196 - RNA, 19 nt, Artificial Sequence
  Description of Artificial Sequence: Synthetic oligonucleotide
aagagccuuccucacccaa

SEQ ID NO: 197 - RNA, 19 nt, Artificial Sequence
  Description of Artificial Sequence: Synthetic oligonucleotide
agagccuuccucacccaaa

SEQ ID NO: 198 - RNA, 19 nt, Artificial Sequence
  Description of Artificial Sequence: Synthetic oligonucleotide
gagccuuccucacccaaac

SEQ ID NO: 199 - RNA, 19 nt, Artificial Sequence
  Description of Artificial Sequence: Synthetic oligonucleotide
agccuuccucacccaaacc

SEQ ID NO: 200 - RNA, 19 nt, Artificial Sequence
  Description of Artificial Sequence: Synthetic oligonucleotide
gccuuccucacccaaaccc

SEQ ID NO: 201 - RNA, 19 nt, Artificial Sequence
  Description of Artificial Sequence: Synthetic oligonucleotide
ccuuccucacccaaaccca

SEQ ID NO: 202 - RNA, 19 nt, Artificial Sequence
  Description of Artificial Sequence: Synthetic oligonucleotide
cuuccucacccaaacccac

SEQ ID NO: 203 - RNA, 19 nt, Artificial Sequence
  Description of Artificial Sequence: Synthetic oligonucleotide
uuccucacccaaacccaca

SEQ ID NO: 204 - RNA, 19 nt, Artificial Sequence
  Description of Artificial Sequence: Synthetic oligonucleotide
uccucacccaaacccacaa

SEQ ID NO: 205 - RNA, 19 nt, Artificial Sequence
  Description of Artificial Sequence: Synthetic oligonucleotide
ccucacccaaacccacaaa

SEQ ID NO: 206 - RNA, 19 nt, Artificial Sequence
  Description of Artificial Sequence: Synthetic oligonucleotide
cucacccaaacccacaaaa

SEQ ID NO: 207 - RNA, 19 nt, Artificial Sequence
  Description of Artificial Sequence: Synthetic oligonucleotide
ucacccaaacccacaaaag

SEQ ID NO: 208 - RNA, 19 nt, Artificial Sequence
  Description of Artificial Sequence: Synthetic oligonucleotide
cacccaaacccacaaaaga

SEQ ID NO: 209 - RNA, 19 nt, Artificial Sequence
  Description of Artificial Sequence: Synthetic oligonucleotide
acccaaacccacaaaagau

SEQ ID NO: 210 - RNA, 19 nt, Artificial Sequence
  Description of Artificial Sequence: Synthetic oligonucleotide
cccaaacccacaaaagaug

SEQ ID NO: 211 - RNA, 19 nt, Artificial Sequence
  Description of Artificial Sequence: Synthetic oligonucleotide
ccaaacccacaaaagaugc

SEQ ID NO: 212 - RNA, 19 nt, Artificial Sequence
  Description of Artificial Sequence: Synthetic oligonucleotide
caaacccacaaaagaugcu

SEQ ID NO: 213 - RNA, 19 nt, Artificial Sequence
  Description of Artificial Sequence: Synthetic oligonucleotide
aaacccacaaaagaugcug

SEQ ID NO: 214 - RNA, 19 nt, Artificial Sequence
  Description of Artificial Sequence: Synthetic oligonucleotide
aacccacaaaagaugcuga

SEQ ID NO: 215 - RNA, 19 nt, Artificial Sequence
  Description of Artificial Sequence: Synthetic oligonucleotide
acccacaaaagaugcugaa

SEQ ID NO: 216 - RNA, 19 nt, Artificial Sequence
  Description of Artificial Sequence: Synthetic oligonucleotide
cccacaaaagaugcugaaa

SEQ ID NO: 217 - RNA, 19 nt, Artificial Sequence
  Description of Artificial Sequence: Synthetic oligonucleotide
ccacaaaagaugcugaaaa

SEQ ID NO: 218 - RNA, 19 nt, Artificial Sequence
  Description of Artificial Sequence: Synthetic oligonucleotide
cacaaaagaugcugaaaaa

SEQ ID NO: 219 - RNA, 19 nt, Artificial Sequence
  Description of Artificial Sequence: Synthetic oligonucleotide
acaaaagaugcugaaaaag

SEQ ID NO: 220 - RNA, 19 nt, Artificial Sequence
  Description of Artificial Sequence: Synthetic oligonucleotide
caaaagaugcugaaaaagc

SEQ ID NO: 221 - RNA, 19 nt, Artificial Sequence
  Description of Artificial Sequence: Synthetic oligonucleotide
aaaagaugcugaaaaagcc

SEQ ID NO: 222 - RNA, 19 nt, Artificial Sequence
  Description of Artificial Sequence: Synthetic oligonucleotide
aaagaugcugaaaaagccu

SEQ ID NO: 223 - RNA, 19 nt, Artificial Sequence
  Description of Artificial Sequence: Synthetic oligonucleotide
aagaugcugaaaaagccuc

SEQ ID NO: 224 - RNA, 19 nt, Artificial Sequence
  Description of Artificial Sequence: Synthetic oligonucleotide
agaugcugaaaaagccucu

SEQ ID NO: 225 - RNA, 19 nt, Artificial Sequence
  Description of Artificial Sequence: Synthetic oligonucleotide
gaugcugaaaaagccucuc

SEQ ID NO: 226 - RNA, 19 nt, Artificial Sequence
  Description of Artificial Sequence: Synthetic oligonucleotide
augcugaaaaagccucucu

SEQ ID NO: 227 - RNA, 19 nt, Artificial Sequence
  Description of Artificial Sequence: Synthetic oligonucleotide
ugcugaaaaagccucucuc

SEQ ID NO: 228 - RNA, 19 nt, Artificial Sequence
  Description of Artificial Sequence: Synthetic oligonucleotide
gcugaaaaagccucucuca

SEQ ID NO: 229 - RNA, 19 nt, Artificial Sequence
  Description of Artificial Sequence: Synthetic oligonucleotide
cugaaaaagccucucucag

SEQ ID NO: 230 - RNA, 19 nt, Artificial Sequence
  Description of Artificial Sequence: Synthetic oligonucleotide
ugaaaaagccucucucagc

SEQ ID NO: 231 - RNA, 19 nt, Artificial Sequence
  Description of Artificial Sequence: Synthetic oligonucleotide
gaaaaagccucucucagcu

SEQ ID NO: 232 - RNA, 19 nt, Artificial Sequence
  Description of Artificial Sequence: Synthetic oligonucleotide
aaaaagccucucucagcug

SEQ ID NO: 233 - RNA, 19 nt, Artificial Sequence
  Description of Artificial Sequence: Synthetic oligonucleotide
aaaagccucucucagcugu

SEQ ID NO: 234 - RNA, 19 nt, Artificial Sequence
  Description of Artificial Sequence: Synthetic oligonucleotide
aaagccucucucagcugug

SEQ ID NO: 235 - RNA, 19 nt, Artificial Sequence
  Description of Artificial Sequence: Synthetic oligonucleotide
aagccucucucagcuguga

SEQ ID NO: 236 - RNA, 19 nt, Artificial Sequence
  Description of Artificial Sequence: Synthetic oligonucleotide
agccucucucagcugugac

SEQ ID NO: 237 - RNA, 19 nt, Artificial Sequence
  Description of Artificial Sequence: Synthetic oligonucleotide
gccucucucagcugugacc

SEQ ID NO: 238 - RNA, 19 nt, Artificial Sequence
  Description of Artificial Sequence: Synthetic oligonucleotide
ccucucucagcugugaccu

SEQ ID NO: 239 - RNA, 19 nt, Artificial Sequence
  Description of Artificial Sequence: Synthetic oligonucleotide
cucucucagcugugaccug

SEQ ID NO: 240 - RNA, 19 nt, Artificial Sequence
  Description of Artificial Sequence: Synthetic oligonucleotide
ucucucagcugugaccugg

SEQ ID NO: 241 - RNA, 19 nt, Artificial Sequence
  Description of Artificial Sequence: Synthetic oligonucleotide
cucucagcugugaccuggc

SEQ ID NO: 242 - RNA, 19 nt, Artificial Sequence
  Description of Artificial Sequence: Synthetic oligonucleotide
ucucagcugugaccuggcu

SEQ ID NO: 243 - RNA, 19 nt, Artificial Sequence
  Description of Artificial Sequence: Synthetic oligonucleotide
cucagcugugaccuggcuc

SEQ ID NO: 244 - RNA, 19 nt, Artificial Sequence
  Description of Artificial Sequence: Synthetic oligonucleotide
ucagcugugaccuggcucu

SEQ ID NO: 245 - RNA, 19 nt, Artificial Sequence
  Description of Artificial Sequence: Synthetic oligonucleotide
cagcugugaccuggcucug

SEQ ID NO: 246 - RNA, 19 nt, Artificial Sequence
  Description of Artificial Sequence: Synthetic oligonucleotide
agcugugaccuggcucugc

SEQ ID NO: 247 - RNA, 19 nt, Artificial Sequence
  Description of Artificial Sequence: Synthetic oligonucleotide
gcugugaccuggcucugca

SEQ ID NO: 248 - RNA, 19 nt, Artificial Sequence
  Description of Artificial Sequence: Synthetic oligonucleotide
cugugaccuggcucugcau

SEQ ID NO: 249 - RNA, 19 nt, Artificial Sequence
  Description of Artificial Sequence: Synthetic oligonucleotide
ugugaccuggcucugcauu

SEQ ID NO: 250 - RNA, 19 nt, Artificial Sequence
  Description of Artificial Sequence: Synthetic oligonucleotide
gugaccuggcucugcauuu

SEQ ID NO: 251 - RNA, 19 nt, Artificial Sequence
  Description of Artificial Sequence: Synthetic oligonucleotide
ugaccuggcucugcauuuu

SEQ ID NO: 252 - RNA, 19 nt, Artificial Sequence
  Description of Artificial Sequence: Synthetic oligonucleotide
gaccuggcucugcauuuuc

SEQ ID NO: 253 - RNA, 19 nt, Artificial Sequence
  Description of Artificial Sequence: Synthetic oligonucleotide
accuggcucugcauuuuca

SEQ ID NO: 254 - RNA, 19 nt, Artificial Sequence
  Description of Artificial Sequence: Synthetic oligonucleotide
ccuggcucugcauuuucau

SEQ ID NO: 255 - RNA, 19 nt, Artificial Sequence
  Description of Artificial Sequence: Synthetic oligonucleotide
cuggcucugcauuuucauc

SEQ ID NO: 256 - RNA, 19 nt, Artificial Sequence
  Description of Artificial Sequence: Synthetic oligonucleotide
uggcucugcauuuucaucg

SEQ ID NO: 257 - RNA, 19 nt, Artificial Sequence
  Description of Artificial Sequence: Synthetic oligonucleotide
ggcucugcauuuucaucgu

SEQ ID NO: 258 - RNA, 19 nt, Artificial Sequence
  Description of Artificial Sequence: Synthetic oligonucleotide
gcucugcauuuucaucgug

SEQ ID NO: 259 - RNA, 19 nt, Artificial Sequence
  Description of Artificial Sequence: Synthetic oligonucleotide
cucugcauuuucaucgugg

SEQ ID NO: 260 - RNA, 19 nt, Artificial Sequence
  Description of Artificial Sequence: Synthetic oligonucleotide
ucugcauuuucaucguggc

SEQ ID NO: 261 - RNA, 19 nt, Artificial Sequence
  Description of Artificial Sequence: Synthetic oligonucleotide
cugcauuuucaucguggcc

SEQ ID NO: 262 - RNA, 19 nt, Artificial Sequence
  Description of Artificial Sequence: Synthetic oligonucleotide
ugcauuuucaucguggccu

SEQ ID NO: 263 - RNA, 19 nt, Artificial Sequence
  Description of Artificial Sequence: Synthetic oligonucleotide
gcauuuucaucguggccuu

SEQ ID NO: 264 - RNA, 19 nt, Artificial Sequence
  Description of Artificial Sequence: Synthetic oligonucleotide
cauuuucaucguggccuuu

SEQ ID NO: 265 - RNA, 19 nt, Artificial Sequence
  Description of Artificial Sequence: Synthetic oligonucleotide
auuuucaucguggccuuug

SEQ ID NO: 266 - RNA, 19 nt, Artificial Sequence
  Description of Artificial Sequence: Synthetic oligonucleotide
uuuucaucguggccuuugu

SEQ ID NO: 267 - RNA, 19 nt, Artificial Sequence
  Description of Artificial Sequence: Synthetic oligonucleotide
uuucaucguggccuuuguc

SEQ ID NO: 268 - RNA, 19 nt, Artificial Sequence
  Description of Artificial Sequence: Synthetic oligonucleotide
uucaucguggccuuuguca

SEQ ID NO: 269 - RNA, 19 nt, Artificial Sequence
  Description of Artificial Sequence: Synthetic oligonucleotide
ucaucguggccuuugucag

SEQ ID NO: 270 - RNA, 19 nt, Artificial Sequence
  Description of Artificial Sequence: Synthetic oligonucleotide
caucguggccuuugucagc

SEQ ID NO: 271 - RNA, 19 nt, Artificial Sequence
  Description of Artificial Sequence: Synthetic oligonucleotide
aucguggccuuugucagcc

SEQ ID NO: 272 - RNA, 19 nt, Artificial Sequence
  Description of Artificial Sequence: Synthetic oligonucleotide
ucguggccuuugucagcca

SEQ ID NO: 273 - RNA, 19 nt, Artificial Sequence
  Description of Artificial Sequence: Synthetic oligonucleotide
cguggccuuugucagccac

SEQ ID NO: 274 - RNA, 19 nt, Artificial Sequence
  Description of Artificial Sequence: Synthetic oligonucleotide
guggccuuugucagccacc

SEQ ID NO: 275 - RNA, 19 nt, Artificial Sequence
  Description of Artificial Sequence: Synthetic oligonucleotide
uggccuuugucagccaccc

SEQ ID NO: 276 - RNA, 19 nt, Artificial Sequence
  Description of Artificial Sequence: Synthetic oligonucleotide
ggccuuugucagccaccca

SEQ ID NO: 277 - RNA, 19 nt, Artificial Sequence
  Description of Artificial Sequence: Synthetic oligonucleotide
gccuuugucagccacccag

SEQ ID NO: 278 - RNA, 19 nt, Artificial Sequence
  Description of Artificial Sequence: Synthetic oligonucleotide
ccuuugucagccacccagc

SEQ ID NO: 279 - RNA, 19 nt, Artificial Sequence
  Description of Artificial Sequence: Synthetic oligonucleotide
cuuugucagccacccagcg

SEQ ID NO: 280 - RNA, 19 nt, Artificial Sequence
  Description of Artificial Sequence: Synthetic oligonucleotide
uuugucagccacccagcgu

SEQ ID NO: 281 - RNA, 19 nt, Artificial Sequence
  Description of Artificial Sequence: Synthetic oligonucleotide
uugucagccacccagcgug

SEQ ID NO: 282 - RNA, 19 nt, Artificial Sequence
  Description of Artificial Sequence: Synthetic oligonucleotide
ugucagccacccagcgugg

SEQ ID NO: 283 - RNA, 19 nt, Artificial Sequence
  Description of Artificial Sequence: Synthetic oligonucleotide
gucagccacccagcguggc

SEQ ID NO: 284 - RNA, 19 nt, Artificial Sequence
  Description of Artificial Sequence: Synthetic oligonucleotide
ucagccacccagcguggcu

SEQ ID NO: 285 - RNA, 19 nt, Artificial Sequence
  Description of Artificial Sequence: Synthetic oligonucleotide
cagccacccagcguggcug

SEQ ID NO: 286 - RNA, 19 nt, Artificial Sequence
  Description of Artificial Sequence: Synthetic oligonucleotide
agccacccagcguggcugc

SEQ ID NO: 287 - RNA, 19 nt, Artificial Sequence
  Description of Artificial Sequence: Synthetic oligonucleotide
gccacccagcguggcugca

SEQ ID NO: 288 - RNA, 19 nt, Artificial Sequence
  Description of Artificial Sequence: Synthetic oligonucleotide
ccacccagcguggcugcag

SEQ ID NO: 289 - RNA, 19 nt, Artificial Sequence
  Description of Artificial Sequence: Synthetic oligonucleotide
cacccagcguggcugcaga

SEQ ID NO: 290 - RNA, 19 nt, Artificial Sequence
  Description of Artificial Sequence: Synthetic oligonucleotide
acccagcguggcugcagaa

SEQ ID NO: 291 - RNA, 19 nt, Artificial Sequence
  Description of Artificial Sequence: Synthetic oligonucleotide
cccagcguggcugcagaag

SEQ ID NO: 292 - RNA, 19 nt, Artificial Sequence
  Description of Artificial Sequence: Synthetic oligonucleotide
ccagcguggcugcagaagc

SEQ ID NO: 293 - RNA, 19 nt, Artificial Sequence
  Description of Artificial Sequence: Synthetic oligonucleotide
cagcguggcugcagaagcu

SEQ ID NO: 294 - RNA, 19 nt, Artificial Sequence
  Description of Artificial Sequence: Synthetic oligonucleotide
agcguggcugcagaagcuc

SEQ ID NO: 295 - RNA, 19 nt, Artificial Sequence
  Description of Artificial Sequence: Synthetic oligonucleotide
gcguggcugcagaagcucu

SEQ ID NO: 296 - RNA, 19 nt, Artificial Sequence
  Description of Artificial Sequence: Synthetic oligonucleotide
cguggcugcagaagcucuc

SEQ ID NO: 297 - RNA, 19 nt, Artificial Sequence
  Description of Artificial Sequence: Synthetic oligonucleotide
guggcugcagaagcucucu

SEQ ID NO: 298 - RNA, 19 nt, Artificial Sequence
  Description of Artificial Sequence: Synthetic oligonucleotide
uggcugcagaagcucucua

SEQ ID NO: 299 - RNA, 19 nt, Artificial Sequence
  Description of Artificial Sequence: Synthetic oligonucleotide
ggcugcagaagcucucuaa

SEQ ID NO: 300 - RNA, 19 nt, Artificial Sequence
  Description of Artificial Sequence: Synthetic oligonucleotide
gcugcagaagcucucuaag

SEQ ID NO: 301 - RNA, 19 nt, Artificial Sequence
  Description of Artificial Sequence: Synthetic oligonucleotide
cugcagaagcucucuaagc

SEQ ID NO: 302 - RNA, 19 nt, Artificial Sequence
  Description of Artificial Sequence: Synthetic oligonucleotide
ugcagaagcucucuaagca

SEQ ID NO: 303 - RNA, 19 nt, Artificial Sequence
  Description of Artificial Sequence: Synthetic oligonucleotide
gcagaagcucucuaagcac

SEQ ID NO: 304 - RNA, 19 nt, Artificial Sequence
  Description of Artificial Sequence: Synthetic oligonucleotide
cagaagcucucuaagcaca

SEQ ID NO: 305 - RNA, 19 nt, Artificial Sequence
  Description of Artificial Sequence: Synthetic oligonucleotide
agaagcucucuaagcacaa

SEQ ID NO: 306 - RNA, 19 nt, Artificial Sequence
  Description of Artificial Sequence: Synthetic oligonucleotide
gaagcucucuaagcacaag

SEQ ID NO: 307 - RNA, 19 nt, Artificial Sequence
  Description of Artificial Sequence: Synthetic oligonucleotide
aagcucucuaagcacaaga

SEQ ID NO: 308 - RNA, 19 nt, Artificial Sequence
  Description of Artificial Sequence: Synthetic oligonucleotide
agcucucuaagcacaagac

SEQ ID NO: 309 - RNA, 19 nt, Artificial Sequence
  Description of Artificial Sequence: Synthetic oligonucleotide
gcucucuaagcacaagaca

SEQ ID NO: 310 - RNA, 19 nt, Artificial Sequence
  Description of Artificial Sequence: Synthetic oligonucleotide
cucucuaagcacaagacac

SEQ ID NO: 311 - RNA, 19 nt, Artificial Sequence
  Description of Artificial Sequence: Synthetic oligonucleotide
ucucuaagcacaagacacc

SEQ ID NO: 312 - RNA, 19 nt, Artificial Sequence
  Description of Artificial Sequence: Synthetic oligonucleotide
cucuaagcacaagacacca

SEQ ID NO: 313 - RNA, 19 nt, Artificial Sequence
  Description of Artificial Sequence: Synthetic oligonucleotide
ucuaagcacaagacaccag

SEQ ID NO: 314 - RNA, 19 nt, Artificial Sequence
  Description of Artificial Sequence: Synthetic oligonucleotide
cuaagcacaagacaccagc

SEQ ID NO: 315 - RNA, 19 nt, Artificial Sequence
  Description of Artificial Sequence: Synthetic oligonucleotide
uaagcacaagacaccagca

SEQ ID NO: 316 - RNA, 19 nt, Artificial Sequence
  Description of Artificial Sequence: Synthetic oligonucleotide
aagcacaagacaccagcac

SEQ ID NO: 317 - RNA, 19 nt, Artificial Sequence
  Description of Artificial Sequence: Synthetic oligonucleotide
agcacaagacaccagcaca

SEQ ID NO: 318 - RNA, 19 nt, Artificial Sequence
  Description of Artificial Sequence: Synthetic oligonucleotide
gcacaagacaccagcacag

SEQ ID NO: 319 - RNA, 19 nt, Artificial Sequence
  Description of Artificial Sequence: Synthetic oligonucleotide
cacaagacaccagcacagc

SEQ ID NO: 320 - RNA, 19 nt, Artificial Sequence
  Description of Artificial Sequence: Synthetic oligonucleotide
acaagacaccagcacagcc

SEQ ID NO: 321 - RNA, 19 nt, Artificial Sequence
  Description of Artificial Sequence: Synthetic oligonucleotide
caagacaccagcacagcca

SEQ ID NO: 322 - RNA, 19 nt, Artificial Sequence
  Description of Artificial Sequence: Synthetic oligonucleotide
aagacaccagcacagccac

SEQ ID NO: 323 - RNA, 19 nt, Artificial Sequence
  Description of Artificial Sequence: Synthetic oligonucleotide
agacaccagcacagccaca

SEQ ID NO: 324 - RNA, 19 nt, Artificial Sequence
  Description of Artificial Sequence: Synthetic oligonucleotide
gacaccagcacagccacag

SEQ ID NO: 325 - RNA, 19 nt, Artificial Sequence
  Description of Artificial Sequence: Synthetic oligonucleotide
acaccagcacagccacagc

SEQ ID NO: 326 - RNA, 19 nt, Artificial Sequence
  Description of Artificial Sequence: Synthetic oligonucleotide
caccagcacagccacagcu

SEQ ID NO: 327 - RNA, 19 nt, Artificial Sequence
  Description of Artificial Sequence: Synthetic oligonucleotide
accagcacagccacagcuc

SEQ ID NO: 328 - RNA, 19 nt, Artificial Sequence
  Description of Artificial Sequence: Synthetic oligonucleotide
ccagcacagccacagcuca

SEQ ID NO: 329 - RNA, 19 nt, Artificial Sequence
  Description of Artificial Sequence: Synthetic oligonucleotide
cagcacagccacagcucaa

SEQ ID NO: 330 - RNA, 19 nt, Artificial Sequence
  Description of Artificial Sequence: Synthetic oligonucleotide
agcacagccacagcucaaa

SEQ ID NO: 331 - RNA, 19 nt, Artificial Sequence
  Description of Artificial Sequence: Synthetic oligonucleotide
gcacagccacagcucaaag

SEQ ID NO: 332 - RNA, 19 nt, Artificial Sequence
  Description of Artificial Sequence: Synthetic oligonucleotide
cacagccacagcucaaagc

SEQ ID NO: 333 - RNA, 19 nt, Artificial Sequence
  Description of Artificial Sequence: Synthetic oligonucleotide
acagccacagcucaaagcg

SEQ ID NO: 334 - RNA, 19 nt, Artificial Sequence
  Description of Artificial Sequence: Synthetic oligonucleotide
cagccacagcucaaagcgg

SEQ ID NO: 335 - RNA, 19 nt, Artificial Sequence
  Description of Artificial Sequence: Synthetic oligonucleotide
agccacagcucaaagcggc

SEQ ID NO: 336 - RNA, 19 nt, Artificial Sequence
  Description of Artificial Sequence: Synthetic oligonucleotide
gccacagcucaaagcggcc

SEQ ID NO: 337 - RNA, 19 nt, Artificial Sequence
  Description of Artificial Sequence: Synthetic oligonucleotide
ccacagcucaaagcggcca

SEQ ID NO: 338 - RNA, 19 nt, Artificial Sequence
  Description of Artificial Sequence: Synthetic oligonucleotide
cacagcucaaagcggccaa

SEQ ID NO: 339 - RNA, 19 nt, Artificial Sequence
  Description of Artificial Sequence: Synthetic oligonucleotide
acagcucaaagcggccaac

SEQ ID NO: 340 - RNA, 19 nt, Artificial Sequence
  Description of Artificial Sequence: Synthetic oligonucleotide
cagcucaaagcggccaacu

SEQ ID NO: 341 - RNA, 19 nt, Artificial Sequence
  Description of Artificial Sequence: Synthetic oligonucleotide
agcucaaagcggccaacug

SEQ ID NO: 342 - RNA, 19 nt, Artificial Sequence
  Description of Artificial Sequence: Synthetic oligonucleotide
gcucaaagcggccaacugc

SEQ ID NO: 343 - RNA, 19 nt, Artificial Sequence
  Description of Artificial Sequence: Synthetic oligonucleotide
cucaaagcggccaacugcu

SEQ ID NO: 344 - RNA, 19 nt, Artificial Sequence
  Description of Artificial Sequence: Synthetic oligonucleotide
ucaaagcggccaacugcug

SEQ ID NO: 345 - RNA, 19 nt, Artificial Sequence
  Description of Artificial Sequence: Synthetic oligonucleotide
caaagcggccaacugcugu

SEQ ID NO: 346 - RNA, 19 nt, Artificial Sequence
  Description of Artificial Sequence: Synthetic oligonucleotide
aaagcggccaacugcugug

SEQ ID NO: 347 - RNA, 19 nt, Artificial Sequence
  Description of Artificial Sequence: Synthetic oligonucleotide
aagcggccaacugcuguga

SEQ ID NO: 348 - RNA, 19 nt, Artificial Sequence
  Description of Artificial Sequence: Synthetic oligonucleotide
agcggccaacugcugugag

SEQ ID NO: 349 - RNA, 19 nt, Artificial Sequence
  Description of Artificial Sequence: Synthetic oligonucleotide
gcggccaacugcugugagg

SEQ ID NO: 350 - RNA, 19 nt, Artificial Sequence
  Description of Artificial Sequence: Synthetic oligonucleotide
cggccaacugcugugagga

SEQ ID NO: 351 - RNA, 19 nt, Artificial Sequence
  Description of Artificial Sequence: Synthetic oligonucleotide
ggccaacugcugugaggag

SEQ ID NO: 352 - RNA, 19 nt, Artificial Sequence
  Description of Artificial Sequence: Synthetic oligonucleotide
gccaacugcugugaggagg

SEQ ID NO: 353 - RNA, 19 nt, Artificial Sequence
  Description of Artificial Sequence: Synthetic oligonucleotide
ccaacugcugugaggaggu

SEQ ID NO: 354 - RNA, 19 nt, Artificial Sequence
  Description of Artificial Sequence: Synthetic oligonucleotide
caacugcugugaggaggug

SEQ ID NO: 355 - RNA, 19 nt, Artificial Sequence
  Description of Artificial Sequence: Synthetic oligonucleotide
aacugcugugaggagguga

SEQ ID NO: 356 - RNA, 19 nt, Artificial Sequence
  Description of Artificial Sequence: Synthetic oligonucleotide
acugcugugaggaggugaa

SEQ ID NO: 357 - RNA, 19 nt, Artificial Sequence
  Description of Artificial Sequence: Synthetic oligonucleotide
cugcugugaggaggugaag

SEQ ID NO: 358 - RNA, 19 nt, Artificial Sequence
  Description of Artificial Sequence: Synthetic oligonucleotide
ugcugugaggaggugaagg

SEQ ID NO: 359 - RNA, 19 nt, Artificial Sequence
  Description of Artificial Sequence: Synthetic oligonucleotide
gcugugaggaggugaagga

SEQ ID NO: 360 - RNA, 19 nt, Artificial Sequence
  Description of Artificial Sequence: Synthetic oligonucleotide
cugugaggaggugaaggag

SEQ ID NO: 361 - RNA, 19 nt, Artificial Sequence
  Description of Artificial Sequence: Synthetic oligonucleotide
ugugaggaggugaaggagc

SEQ ID NO: 362 - RNA, 19 nt, Artificial Sequence
  Description of Artificial Sequence: Synthetic oligonucleotide
gugaggaggugaaggagcu

SEQ ID NO: 363 - RNA, 19 nt, Artificial Sequence
  Description of Artificial Sequence: Synthetic oligonucleotide
ugaggaggugaaggagcuc

SEQ ID NO: 364 - RNA, 19 nt, Artificial Sequence
  Description of Artificial Sequence: Synthetic oligonucleotide
gaggaggugaaggagcuca

SEQ ID NO: 365 - RNA, 19 nt, Artificial Sequence
  Description of Artificial Sequence: Synthetic oligonucleotide
aggaggugaaggagcucaa

SEQ ID NO: 366 - RNA, 19 nt, Artificial Sequence
  Description of Artificial Sequence: Synthetic oligonucleotide
ggaggugaaggagcucaag

SEQ ID NO: 367 - RNA, 19 nt, Artificial Sequence
  Description of Artificial Sequence: Synthetic oligonucleotide
gaggugaaggagcucaagg

SEQ ID NO: 368 - RNA, 19 nt, Artificial Sequence
  Description of Artificial Sequence: Synthetic oligonucleotide
aggugaaggagcucaaggc

SEQ ID NO: 369 - RNA, 19 nt, Artificial Sequence
  Description of Artificial Sequence: Synthetic oligonucleotide
ggugaaggagcucaaggcc

SEQ ID NO: 370 - RNA, 19 nt, Artificial Sequence
  Description of Artificial Sequence: Synthetic oligonucleotide
gugaaggagcucaaggccc

SEQ ID NO: 371 - RNA, 19 nt, Artificial Sequence
  Description of Artificial Sequence: Synthetic oligonucleotide
ugaaggagcucaaggccca

SEQ ID NO: 372 - RNA, 19 nt, Artificial Sequence
  Description of Artificial Sequence: Synthetic oligonucleotide
gaaggagcucaaggcccaa

SEQ ID NO: 373 - RNA, 19 nt, Artificial Sequence
  Description of Artificial Sequence: Synthetic oligonucleotide
aaggagcucaaggcccaag

SEQ ID NO: 374 - RNA, 19 nt, Artificial Sequence
  Description of Artificial Sequence: Synthetic oligonucleotide
aggagcucaaggcccaagu

SEQ ID NO: 375 - RNA, 19 nt, Artificial Sequence
  Description of Artificial Sequence: Synthetic oligonucleotide
ggagcucaaggcccaaguu

SEQ ID NO: 376 - RNA, 19 nt, Artificial Sequence
  Description of Artificial Sequence: Synthetic oligonucleotide
gagcucaaggcccaaguug

SEQ ID NO: 377 - RNA, 19 nt, Artificial Sequence
  Description of Artificial Sequence: Synthetic oligonucleotide
agcucaaggcccaaguugc

SEQ ID NO: 378 - RNA, 19 nt, Artificial Sequence
  Description of Artificial Sequence: Synthetic oligonucleotide
gcucaaggcccaaguugcc

SEQ ID NO: 379 - RNA, 19 nt, Artificial Sequence
  Description of Artificial Sequence: Synthetic oligonucleotide
cucaaggcccaaguugcca

SEQ ID NO: 380 - RNA, 19 nt, Artificial Sequence
  Description of Artificial Sequence: Synthetic oligonucleotide
ucaaggcccaaguugccaa

SEQ ID NO: 381 - RNA, 19 nt, Artificial Sequence
  Description of Artificial Sequence: Synthetic oligonucleotide
caaggcccaaguugccaac

SEQ ID NO: 382 - RNA, 19 nt, Artificial Sequence
  Description of Artificial Sequence: Synthetic oligonucleotide
aaggcccaaguugccaacc

SEQ ID NO: 383 - RNA, 19 nt, Artificial Sequence
  Description of Artificial Sequence: Synthetic oligonucleotide
aggcccaaguugccaaccu

SEQ ID NO: 384 - RNA, 19 nt, Artificial Sequence
  Description of Artificial Sequence: Synthetic oligonucleotide
ggcccaaguugccaaccuu

SEQ ID NO: 385 - RNA, 19 nt, Artificial Sequence
  Description of Artificial Sequence: Synthetic oligonucleotide
gcccaaguugccaaccuua

SEQ ID NO: 386 - RNA, 19 nt, Artificial Sequence
  Description of Artificial Sequence: Synthetic oligonucleotide
cccaaguugccaaccuuag

SEQ ID NO: 387 - RNA, 19 nt, Artificial Sequence
  Description of Artificial Sequence: Synthetic oligonucleotide
ccaaguugccaaccuuagc

SEQ ID NO: 388 - RNA, 19 nt, Artificial Sequence
  Description of Artificial Sequence: Synthetic oligonucleotide
caaguugccaaccuuagca

SEQ ID NO: 389 - RNA, 19 nt, Artificial Sequence
  Description of Artificial Sequence: Synthetic oligonucleotide
aaguugccaaccuuagcag

SEQ ID NO: 390 - RNA, 19 nt, Artificial Sequence
  Description of Artificial Sequence: Synthetic oligonucleotide
aguugccaaccuuagcagc

SEQ ID NO: 391 - RNA, 19 nt, Artificial Sequence
  Description of Artificial Sequence: Synthetic oligonucleotide
guugccaaccuuagcagcc

SEQ ID NO: 392 - RNA, 19 nt, Artificial Sequence
  Description of Artificial Sequence: Synthetic oligonucleotide
uugccaaccuuagcagccu

SEQ ID NO: 393 - RNA, 19 nt, Artificial Sequence
  Description of Artificial Sequence: Synthetic oligonucleotide
ugccaaccuuagcagccug

SEQ ID NO: 394 - RNA, 19 nt, Artificial Sequence
  Description of Artificial Sequence: Synthetic oligonucleotide
gccaaccuuagcagccugc

SEQ ID NO: 395 - RNA, 19 nt, Artificial Sequence
  Description of Artificial Sequence: Synthetic oligonucleotide
ccaaccuuagcagccugcu

SEQ ID NO: 396 - RNA, 19 nt, Artificial Sequence
  Description of Artificial Sequence: Synthetic oligonucleotide
caaccuuagcagccugcug

SEQ ID NO: 397 - RNA, 19 nt, Artificial Sequence
  Description of Artificial Sequence: Synthetic oligonucleotide
aaccuuagcagccugcuga

SEQ ID NO: 398 - RNA, 19 nt, Artificial Sequence
  Description of Artificial Sequence: Synthetic oligonucleotide
accuuagcagccugcugag

SEQ ID NO: 399 - RNA, 19 nt, Artificial Sequence
  Description of Artificial Sequence: Synthetic oligonucleotide
ccuuagcagccugcugagu

SEQ ID NO: 400 - RNA, 19 nt, Artificial Sequence
  Description of Artificial Sequence: Synthetic oligonucleotide
cuuagcagccugcugagug

SEQ ID NO: 401 - RNA, 19 nt, Artificial Sequence
  Description of Artificial Sequence: Synthetic oligonucleotide
uuagcagccugcugaguga

SEQ ID NO: 402 - RNA, 19 nt, Artificial Sequence
  Description of Artificial Sequence: Synthetic oligonucleotide
uagcagccugcugagugaa

SEQ ID NO: 403 - RNA, 19 nt, Artificial Sequence
  Description of Artificial Sequence: Synthetic oligonucleotide
agcagccugcugagugaac

SEQ ID NO: 404 - RNA, 19 nt, Artificial Sequence
  Description of Artificial Sequence: Synthetic oligonucleotide
gcagccugcugagugaacu

SEQ ID NO: 405 - RNA, 19 nt, Artificial Sequence
  Description of Artificial Sequence: Synthetic oligonucleotide
cagccugcugagugaacug

SEQ ID NO: 406 - RNA, 19 nt, Artificial Sequence
  Description of Artificial Sequence: Synthetic oligonucleotide
agccugcugagugaacuga

SEQ ID NO: 407 - RNA, 19 nt, Artificial Sequence
  Description of Artificial Sequence: Synthetic oligonucleotide
gccugcugagugaacugaa

SEQ ID NO: 408 - RNA, 19 nt, Artificial Sequence
  Description of Artificial Sequence: Synthetic oligonucleotide
ccugcugagugaacugaac

SEQ ID NO: 409 - RNA, 19 nt, Artificial Sequence
  Description of Artificial Sequence: Synthetic oligonucleotide
cugcugagugaacugaaca

SEQ ID NO: 410 - RNA, 19 nt, Artificial Sequence
  Description of Artificial Sequence: Synthetic oligonucleotide
ugcugagugaacugaacaa

SEQ ID NO: 411 - RNA, 19 nt, Artificial Sequence
  Description of Artificial Sequence: Synthetic oligonucleotide
gcugagugaacugaacaag

SEQ ID NO: 412 - RNA, 19 nt, Artificial Sequence
  Description of Artificial Sequence: Synthetic oligonucleotide
cugagugaacugaacaaga

SEQ ID NO: 413 - RNA, 19 nt, Artificial Sequence
  Description of Artificial Sequence: Synthetic oligonucleotide
ugagugaacugaacaagaa

SEQ ID NO: 414 - RNA, 19 nt, Artificial Sequence
  Description of Artificial Sequence: Synthetic oligonucleotide
gagugaacugaacaagaag

SEQ ID NO: 415 - RNA, 19 nt, Artificial Sequence
  Description of Artificial Sequence: Synthetic oligonucleotide
agugaacugaacaagaagc

SEQ ID NO: 416 - RNA, 19 nt, Artificial Sequence
  Description of Artificial Sequence: Synthetic oligonucleotide
gugaacugaacaagaagca

SEQ ID NO: 417 - RNA, 19 nt, Artificial Sequence
  Description of Artificial Sequence: Synthetic oligonucleotide
ugaacugaacaagaagcag

SEQ ID NO: 418 - RNA, 19 nt, Artificial Sequence
  Description of Artificial Sequence: Synthetic oligonucleotide
gaacugaacaagaagcagg

SEQ ID NO: 419 - RNA, 19 nt, Artificial Sequence
  Description of Artificial Sequence: Synthetic oligonucleotide
aacugaacaagaagcagga

SEQ ID NO: 420 - RNA, 19 nt, Artificial Sequence
  Description of Artificial Sequence: Synthetic oligonucleotide
acugaacaagaagcaggag

SEQ ID NO: 421 - RNA, 19 nt, Artificial Sequence
  Description of Artificial Sequence: Synthetic oligonucleotide
cugaacaagaagcaggaga

SEQ ID NO: 422 - RNA, 19 nt, Artificial Sequence
  Description of Artificial Sequence: Synthetic oligonucleotide
ugaacaagaagcaggagag

SEQ ID NO: 423 - RNA, 19 nt, Artificial Sequence
  Description of Artificial Sequence: Synthetic oligonucleotide
gaacaagaagcaggagagg

SEQ ID NO: 424 - RNA, 19 nt, Artificial Sequence
  Description of Artificial Sequence: Synthetic oligonucleotide
aacaagaagcaggagaggg

SEQ ID NO: 425 - RNA, 19 nt, Artificial Sequence
  Description of Artificial Sequence: Synthetic oligonucleotide
acaagaagcaggagaggga

SEQ ID NO: 426 - RNA, 19 nt, Artificial Sequence
  Description of Artificial Sequence: Synthetic oligonucleotide
caagaagcaggagagggac

SEQ ID NO: 427 - RNA, 19 nt, Artificial Sequence
  Description of Artificial Sequence: Synthetic oligonucleotide
aagaagcaggagagggacu

SEQ ID NO: 428 - RNA, 19 nt, Artificial Sequence
  Description of Artificial Sequence: Synthetic oligonucleotide
agaagcaggagagggacug

SEQ ID NO: 429 - RNA, 19 nt, Artificial Sequence
  Description of Artificial Sequence: Synthetic oligonucleotide
gaagcaggagagggacugg

SEQ ID NO: 430 - RNA, 19 nt, Artificial Sequence
  Description of Artificial Sequence: Synthetic oligonucleotide
aagcaggagagggacuggg

SEQ ID NO: 431 - RNA, 19 nt, Artificial Sequence
  Description of Artificial Sequence: Synthetic oligonucleotide
agcaggagagggacugggu

SEQ ID NO: 432 - RNA, 19 nt, Artificial Sequence
  Description of Artificial Sequence: Synthetic oligonucleotide
gcaggagagggacuggguc

SEQ ID NO: 433 - RNA, 19 nt, Artificial Sequence
  Description of Artificial Sequence: Synthetic oligonucleotide
caggagagggacuggguca

SEQ ID NO: 434 - RNA, 19 nt, Artificial Sequence
  Description of Artificial Sequence: Synthetic oligonucleotide
aggagagggacugggucag

SEQ ID NO: 435 - RNA, 19 nt, Artificial Sequence
  Description of Artificial Sequence: Synthetic oligonucleotide
ggagagggacugggucagc

SEQ ID NO: 436 - RNA, 19 nt, Artificial Sequence
  Description of Artificial Sequence: Synthetic oligonucleotide
gagagggacugggucagcg

SEQ ID NO: 437 - RNA, 19 nt, Artificial Sequence
  Description of Artificial Sequence: Synthetic oligonucleotide
agagggacugggucagcgu

SEQ ID NO: 438 - RNA, 19 nt, Artificial Sequence
  Description of Artificial Sequence: Synthetic oligonucleotide
gagggacugggucagcgug

SEQ ID NO: 439 - RNA, 19 nt, Artificial Sequence
  Description of Artificial Sequence: Synthetic oligonucleotide
agggacugggucagcgugg

SEQ ID NO: 440 - RNA, 19 nt, Artificial Sequence
  Description of Artificial Sequence: Synthetic oligonucleotide
gggacugggucagcguggu

SEQ ID NO: 441 - RNA, 19 nt, Artificial Sequence
  Description of Artificial Sequence: Synthetic oligonucleotide
ggacugggucagcgugguc

SEQ ID NO: 442 - RNA, 19 nt, Artificial Sequence
  Description of Artificial Sequence: Synthetic oligonucleotide
gacugggucagcgugguca

SEQ ID NO: 443 - RNA, 19 nt, Artificial Sequence
  Description of Artificial Sequence: Synthetic oligonucleotide
acugggucagcguggucau

SEQ ID NO: 444 - RNA, 19 nt, Artificial Sequence
  Description of Artificial Sequence: Synthetic oligonucleotide
cugggucagcguggucaug

SEQ ID NO: 445 - RNA, 19 nt, Artificial Sequence
  Description of Artificial Sequence: Synthetic oligonucleotide
ugggucagcguggucaugc

SEQ ID NO: 446 - RNA, 19 nt, Artificial Sequence
  Description of Artificial Sequence: Synthetic oligonucleotide
gggucagcguggucaugca

SEQ ID NO: 447 - RNA, 19 nt, Artificial Sequence
  Description of Artificial Sequence: Synthetic oligonucleotide
ggucagcguggucaugcag

SEQ ID NO: 448 - RNA, 19 nt, Artificial Sequence
  Description of Artificial Sequence: Synthetic oligonucleotide
gucagcguggucaugcagg

SEQ ID NO: 449 - RNA, 19 nt, Artificial Sequence
  Description of Artificial Sequence: Synthetic oligonucleotide
ucagcguggucaugcaggu

SEQ ID NO: 450 - RNA, 19 nt, Artificial Sequence
  Description of Artificial Sequence: Synthetic oligonucleotide
cagcguggucaugcaggug

SEQ ID NO: 451 - RNA, 19 nt, Artificial Sequence
  Description of Artificial Sequence: Synthetic oligonucleotide
agcguggucaugcagguga

SEQ ID NO: 452 - RNA, 19 nt, Artificial Sequence
  Description of Artificial Sequence: Synthetic oligonucleotide
gcguggucaugcaggugau

SEQ ID NO: 453 - RNA, 19 nt, Artificial Sequence
  Description of Artificial Sequence: Synthetic oligonucleotide
cguggucaugcaggugaug

SEQ ID NO: 454 - RNA, 19 nt, Artificial Sequence
  Description of Artificial Sequence: Synthetic oligonucleotide
guggucaugcaggugaugg

SEQ ID NO: 455 - RNA, 19 nt, Artificial Sequence
  Description of Artificial Sequence: Synthetic oligonucleotide
uggucaugcaggugaugga

SEQ ID NO: 456 - RNA, 19 nt, Artificial Sequence
  Description of Artificial Sequence: Synthetic oligonucleotide
ggucaugcaggugauggag

SEQ ID NO: 457 - RNA, 19 nt, Artificial Sequence
  Description of Artificial Sequence: Synthetic oligonucleotide
gucaugcaggugauggagc

SEQ ID NO: 458 - RNA, 19 nt, Artificial Sequence
  Description of Artificial Sequence: Synthetic oligonucleotide
ucaugcaggugauggagcu

SEQ ID NO: 459 - RNA, 19 nt, Artificial Sequence
  Description of Artificial Sequence: Synthetic oligonucleotide
caugcaggugauggagcug

SEQ ID NO: 460 - RNA, 19 nt, Artificial Sequence
  Description of Artificial Sequence: Synthetic oligonucleotide
augcaggugauggagcugg

SEQ ID NO: 461 - RNA, 19 nt, Artificial Sequence
  Description of Artificial Sequence: Synthetic oligonucleotide
ugcaggugauggagcugga

SEQ ID NO: 462 - RNA, 19 nt, Artificial Sequence
  Description of Artificial Sequence: Synthetic oligonucleotide
gcaggugauggagcuggag

SEQ ID NO: 463 - RNA, 19 nt, Artificial Sequence
  Description of Artificial Sequence: Synthetic oligonucleotide
caggugauggagcuggaga

SEQ ID NO: 464 - RNA, 19 nt, Artificial Sequence
  Description of Artificial Sequence: Synthetic oligonucleotide
aggugauggagcuggagag

SEQ ID NO: 465 - RNA, 19 nt, Artificial Sequence
  Description of Artificial Sequence: Synthetic oligonucleotide
ggugauggagcuggagagc

SEQ ID NO: 466 - RNA, 19 nt, Artificial Sequence
  Description of Artificial Sequence: Synthetic oligonucleotide
gugauggagcuggagagca

SEQ ID NO: 467 - RNA, 19 nt, Artificial Sequence
  Description of Artificial Sequence: Synthetic oligonucleotide
ugauggagcuggagagcaa

SEQ ID NO: 468 - RNA, 19 nt, Artificial Sequence
  Description of Artificial Sequence: Synthetic oligonucleotide
gauggagcuggagagcaac

SEQ ID NO: 469 - RNA, 19 nt, Artificial Sequence
  Description of Artificial Sequence: Synthetic oligonucleotide
auggagcuggagagcaaca

SEQ ID NO: 470 - RNA, 19 nt, Artificial Sequence
  Description of Artificial Sequence: Synthetic oligonucleotide
uggagcuggagagcaacag

SEQ ID NO: 471 - RNA, 19 nt, Artificial Sequence
  Description of Artificial Sequence: Synthetic oligonucleotide
ggagcuggagagcaacagc

SEQ ID NO: 472 - RNA, 19 nt, Artificial Sequence
  Description of Artificial Sequence: Synthetic oligonucleotide
gagcuggagagcaacagca

SEQ ID NO: 473 - RNA, 19 nt, Artificial Sequence
  Description of Artificial Sequence: Synthetic oligonucleotide
agcuggagagcaacagcaa

SEQ ID NO: 474 - RNA, 19 nt, Artificial Sequence
  Description of Artificial Sequence: Synthetic oligonucleotide
gcuggagagcaacagcaag

SEQ ID NO: 475 - RNA, 19 nt, Artificial Sequence
  Description of Artificial Sequence: Synthetic oligonucleotide
cuggagagcaacagcaagc

SEQ ID NO: 476 - RNA, 19 nt, Artificial Sequence
  Description of Artificial Sequence: Synthetic oligonucleotide
uggagagcaacagcaagcg

SEQ ID NO: 477 - RNA, 19 nt, Artificial Sequence
  Description of Artificial Sequence: Synthetic oligonucleotide
ggagagcaacagcaagcgc

SEQ ID NO: 478 - RNA, 19 nt, Artificial Sequence
  Description of Artificial Sequence: Synthetic oligonucleotide
gagagcaacagcaagcgca

SEQ ID NO: 479 - RNA, 19 nt, Artificial Sequence
  Description of Artificial Sequence: Synthetic oligonucleotide
agagcaacagcaagcgcau

SEQ ID NO: 480 - RNA, 19 nt, Artificial Sequence
  Description of Artificial Sequence: Synthetic oligonucleotide
gagcaacagcaagcgcaug

SEQ ID NO: 481 - RNA, 19 nt, Artificial Sequence
  Description of Artificial Sequence: Synthetic oligonucleotide
agcaacagcaagcgcaugg

SEQ ID NO: 482 - RNA, 19 nt, Artificial Sequence
  Description of Artificial Sequence: Synthetic oligonucleotide
gcaacagcaagcgcaugga

SEQ ID NO: 483 - RNA, 19 nt, Artificial Sequence
  Description of Artificial Sequence: Synthetic oligonucleotide
caacagcaagcgcauggag

SEQ ID NO: 484 - RNA, 19 nt, Artificial Sequence
  Description of Artificial Sequence: Synthetic oligonucleotide
aacagcaagcgcauggagu

SEQ ID NO: 485 - RNA, 19 nt, Artificial Sequence
  Description of Artificial Sequence: Synthetic oligonucleotide
acagcaagcgcauggaguc

SEQ ID NO: 486 - RNA, 19 nt, Artificial Sequence
  Description of Artificial Sequence: Synthetic oligonucleotide
cagcaagcgcauggagucg

SEQ ID NO: 487 - RNA, 19 nt, Artificial Sequence
  Description of Artificial Sequence: Synthetic oligonucleotide
agcaagcgcauggagucgc

SEQ ID NO: 488 - RNA, 19 nt, Artificial Sequence
  Description of Artificial Sequence: Synthetic oligonucleotide
gcaagcgcauggagucgcg

SEQ ID NO: 489 - RNA, 19 nt, Artificial Sequence
  Description of Artificial Sequence: Synthetic oligonucleotide
caagcgcauggagucgcgg

SEQ ID NO: 490 - RNA, 19 nt, Artificial Sequence
  Description of Artificial Sequence: Synthetic oligonucleotide
aagcgcauggagucgcggc

SEQ ID NO: 491 - RNA, 19 nt, Artificial Sequence
  Description of Artificial Sequence: Synthetic oligonucleotide
agcgcauggagucgcggcu

SEQ ID NO: 492 - RNA, 19 nt, Artificial Sequence
  Description of Artificial Sequence: Synthetic oligonucleotide
gcgcauggagucgcggcuc

SEQ ID NO: 493 - RNA, 19 nt, Artificial Sequence
  Description of Artificial Sequence: Synthetic oligonucleotide
cgcauggagucgcggcuca

SEQ ID NO: 494 - RNA, 19 nt, Artificial Sequence
  Description of Artificial Sequence: Synthetic oligonucleotide
gcauggagucgcggcucac

SEQ ID NO: 495 - RNA, 19 nt, Artificial Sequence
  Description of Artificial Sequence: Synthetic oligonucleotide
cauggagucgcggcucaca

SEQ ID NO: 496 - RNA, 19 nt, Artificial Sequence
  Description of Artificial Sequence: Synthetic oligonucleotide
auggagucgcggcucacag

SEQ ID NO: 497 - RNA, 19 nt, Artificial Sequence
  Description of Artificial Sequence: Synthetic oligonucleotide
uggagucgcggcucacaga

SEQ ID NO: 498 - RNA, 19 nt, Artificial Sequence
  Description of Artificial Sequence: Synthetic oligonucleotide
ggagucgcggcucacagau

SEQ ID NO: 499 - RNA, 19 nt, Artificial Sequence
  Description of Artificial Sequence: Synthetic oligonucleotide
gagucgcggcucacagaug

SEQ ID NO: 500 - RNA, 19 nt, Artificial Sequence
  Description of Artificial Sequence: Synthetic oligonucleotide
agucgcggcucacagaugc

SEQ ID NO: 501 - RNA, 19 nt, Artificial Sequence
  Description of Artificial Sequence: Synthetic oligonucleotide
gucgcggcucacagaugcu

SEQ ID NO: 502 - RNA, 19 nt, Artificial Sequence
  Description of Artificial Sequence: Synthetic oligonucleotide
ucgcggcucacagaugcug

SEQ ID NO: 503 - RNA, 19 nt, Artificial Sequence
  Description of Artificial Sequence: Synthetic oligonucleotide
cgcggcucacagaugcuga

SEQ ID NO: 504 - RNA, 19 nt, Artificial Sequence
  Description of Artificial Sequence: Synthetic oligonucleotide
gcggcucacagaugcugag

SEQ ID NO: 505 - RNA, 19 nt, Artificial Sequence
  Description of Artificial Sequence: Synthetic oligonucleotide
cggcucacagaugcugaga

SEQ ID NO: 506 - RNA, 19 nt, Artificial Sequence
  Description of Artificial Sequence: Synthetic oligonucleotide
ggcucacagaugcugagag

SEQ ID NO: 507 - RNA, 19 nt, Artificial Sequence
  Description of Artificial Sequence: Synthetic oligonucleotide
gcucacagaugcugagagc

SEQ ID NO: 508 - RNA, 19 nt, Artificial Sequence
  Description of Artificial Sequence: Synthetic oligonucleotide
cucacagaugcugagagca

SEQ ID NO: 509 - RNA, 19 nt, Artificial Sequence
  Description of Artificial Sequence: Synthetic oligonucleotide
ucacagaugcugagagcaa

SEQ ID NO: 510 - RNA, 19 nt, Artificial Sequence
  Description of Artificial Sequence: Synthetic oligonucleotide
cacagaugcugagagcaag

SEQ ID NO: 511 - RNA, 19 nt, Artificial Sequence
  Description of Artificial Sequence: Synthetic oligonucleotide
acagaugcugagagcaagu

SEQ ID NO: 512 - RNA, 19 nt, Artificial Sequence
  Description of Artificial Sequence: Synthetic oligonucleotide
cagaugcugagagcaagua

SEQ ID NO: 513 - RNA, 19 nt, Artificial Sequence
  Description of Artificial Sequence: Synthetic oligonucleotide
agaugcugagagcaaguac

SEQ ID NO: 514 - RNA, 19 nt, Artificial Sequence
  Description of Artificial Sequence: Synthetic oligonucleotide
gaugcugagagcaaguacu

SEQ ID NO: 515 - RNA, 19 nt, Artificial Sequence
  Description of Artificial Sequence: Synthetic oligonucleotide
augcugagagcaaguacuc

SEQ ID NO: 516 - RNA, 19 nt, Artificial Sequence
  Description of Artificial Sequence: Synthetic oligonucleotide
ugcugagagcaaguacucc

SEQ ID NO: 517 - RNA, 19 nt, Artificial Sequence
  Description of Artificial Sequence: Synthetic oligonucleotide
gcugagagcaaguacuccg

SEQ ID NO: 518 - RNA, 19 nt, Artificial Sequence
  Description of Artificial Sequence: Synthetic oligonucleotide
cugagagcaaguacuccga

SEQ ID NO: 519 - RNA, 19 nt, Artificial Sequence
  Description of Artificial Sequence: Synthetic oligonucleotide
ugagagcaaguacuccgag

SEQ ID NO: 520 - RNA, 19 nt, Artificial Sequence
  Description of Artificial Sequence: Synthetic oligonucleotide
gagagcaaguacuccgaga

SEQ ID NO: 521 - RNA, 19 nt, Artificial Sequence
  Description of Artificial Sequence: Synthetic oligonucleotide
agagcaaguacuccgagau

SEQ ID NO: 522 - RNA, 19 nt, Artificial Sequence
  Description of Artificial Sequence: Synthetic oligonucleotide
gagcaaguacuccgagaug

SEQ ID NO: 523 - RNA, 19 nt, Artificial Sequence
  Description of Artificial Sequence: Synthetic oligonucleotide
agcaaguacuccgagauga

SEQ ID NO: 524 - RNA, 19 nt, Artificial Sequence
  Description of Artificial Sequence: Synthetic oligonucleotide
gcaaguacuccgagaugaa

SEQ ID NO: 525 - RNA, 19 nt, Artificial Sequence
  Description of Artificial Sequence: Synthetic oligonucleotide
caaguacuccgagaugaac

SEQ ID NO: 526 - RNA, 19 nt, Artificial Sequence
  Description of Artificial Sequence: Synthetic oligonucleotide
aaguacuccgagaugaaca

SEQ ID NO: 527 - RNA, 19 nt, Artificial Sequence
  Description of Artificial Sequence: Synthetic oligonucleotide
aguacuccgagaugaacaa

SEQ ID NO: 528 - RNA, 19 nt, Artificial Sequence
  Description of Artificial Sequence: Synthetic oligonucleotide
guacuccgagaugaacaac

SEQ ID NO: 529 - RNA, 19 nt, Artificial Sequence
  Description of Artificial Sequence: Synthetic oligonucleotide
uacuccgagaugaacaacc

SEQ ID NO: 530 - RNA, 19 nt, Artificial Sequence
  Description of Artificial Sequence: Synthetic oligonucleotide
acuccgagaugaacaacca

SEQ ID NO: 531 - RNA, 19 nt, Artificial Sequence
  Description of Artificial Sequence: Synthetic oligonucleotide
cuccgagaugaacaaccaa

SEQ ID NO: 532 - RNA, 19 nt, Artificial Sequence
  Description of Artificial Sequence: Synthetic oligonucleotide
uccgagaugaacaaccaaa

SEQ ID NO: 533 - RNA, 19 nt, Artificial Sequence
  Description of Artificial Sequence: Synthetic oligonucleotide
ccgagaugaacaaccaaau

SEQ ID NO: 534 - RNA, 19 nt, Artificial Sequence
  Description of Artificial Sequence: Synthetic oligonucleotide
cgagaugaacaaccaaauu

SEQ ID NO: 535 - RNA, 19 nt, Artificial Sequence
  Description of Artificial Sequence: Synthetic oligonucleotide
gagaugaacaaccaaauug

SEQ ID NO: 536 - RNA, 19 nt, Artificial Sequence
  Description of Artificial Sequence: Synthetic oligonucleotide
agaugaacaaccaaauuga

SEQ ID NO: 537 - RNA, 19 nt, Artificial Sequence
  Description of Artificial Sequence: Synthetic oligonucleotide
gaugaacaaccaaauugac

SEQ ID NO: 538 - RNA, 19 nt, Artificial Sequence
  Description of Artificial Sequence: Synthetic oligonucleotide
augaacaaccaaauugaca

SEQ ID NO: 539 - RNA, 19 nt, Artificial Sequence
  Description of Artificial Sequence: Synthetic oligonucleotide
ugaacaaccaaauugacau

SEQ ID NO: 540 - RNA, 19 nt, Artificial Sequence
  Description of Artificial Sequence: Synthetic oligonucleotide
gaacaaccaaauugacauc

SEQ ID NO: 541 - RNA, 19 nt, Artificial Sequence
  Description of Artificial Sequence: Synthetic oligonucleotide
aacaaccaaauugacauca

SEQ ID NO: 542 - RNA, 19 nt, Artificial Sequence
  Description of Artificial Sequence: Synthetic oligonucleotide
acaaccaaauugacaucau

SEQ ID NO: 543 - RNA, 19 nt, Artificial Sequence
  Description of Artificial Sequence: Synthetic oligonucleotide
caaccaaauugacaucaug

SEQ ID NO: 544 - RNA, 19 nt, Artificial Sequence
  Description of Artificial Sequence: Synthetic oligonucleotide
aaccaaauugacaucaugc

SEQ ID NO: 545 - RNA, 19 nt, Artificial Sequence
  Description of Artificial Sequence: Synthetic oligonucleotide
accaaauugacaucaugca

SEQ ID NO: 546 - RNA, 19 nt, Artificial Sequence
  Description of Artificial Sequence: Synthetic oligonucleotide
ccaaauugacaucaugcag

SEQ ID NO: 547 - RNA, 19 nt, Artificial Sequence
  Description of Artificial Sequence: Synthetic oligonucleotide
caaauugacaucaugcagc

SEQ ID NO: 548 - RNA, 19 nt, Artificial Sequence
  Description of Artificial Sequence: Synthetic oligonucleotide
aaauugacaucaugcagcu

SEQ ID NO: 549 - RNA, 19 nt, Artificial Sequence
  Description of Artificial Sequence: Synthetic oligonucleotide
aauugacaucaugcagcug

SEQ ID NO: 550 - RNA, 19 nt, Artificial Sequence
  Description of Artificial Sequence: Synthetic oligonucleotide
auugacaucaugcagcugc

SEQ ID NO: 551 - RNA, 19 nt, Artificial Sequence
  Description of Artificial Sequence: Synthetic oligonucleotide
uugacaucaugcagcugca

SEQ ID NO: 552 - RNA, 19 nt, Artificial Sequence
  Description of Artificial Sequence: Synthetic oligonucleotide
ugacaucaugcagcugcag

SEQ ID NO: 553 - RNA, 19 nt, Artificial Sequence
  Description of Artificial Sequence: Synthetic oligonucleotide
gacaucaugcagcugcagg

SEQ ID NO: 554 - RNA, 19 nt, Artificial Sequence
  Description of Artificial Sequence: Synthetic oligonucleotide
acaucaugcagcugcaggc

SEQ ID NO: 555 - RNA, 19 nt, Artificial Sequence
  Description of Artificial Sequence: Synthetic oligonucleotide
caucaugcagcugcaggca

SEQ ID NO: 556 - RNA, 19 nt, Artificial Sequence
  Description of Artificial Sequence: Synthetic oligonucleotide
aucaugcagcugcaggcag

SEQ ID NO: 557 - RNA, 19 nt, Artificial Sequence
  Description of Artificial Sequence: Synthetic oligonucleotide
ucaugcagcugcaggcagc

SEQ ID NO: 558 - RNA, 19 nt, Artificial Sequence
  Description of Artificial Sequence: Synthetic oligonucleotide
caugcagcugcaggcagca

SEQ ID NO: 559 - RNA, 19 nt, Artificial Sequence
  Description of Artificial Sequence: Synthetic oligonucleotide
augcagcugcaggcagcac

SEQ ID NO: 560 - RNA, 19 nt, Artificial Sequence
  Description of Artificial Sequence: Synthetic oligonucleotide
ugcagcugcaggcagcaca

SEQ ID NO: 561 - RNA, 19 nt, Artificial Sequence
  Description of Artificial Sequence: Synthetic oligonucleotide
gcagcugcaggcagcacag

SEQ ID NO: 562 - RNA, 19 nt, Artificial Sequence
  Description of Artificial Sequence: Synthetic oligonucleotide
cagcugcaggcagcacaga

SEQ ID NO: 563 - RNA, 19 nt, Artificial Sequence
  Description of Artificial Sequence: Synthetic oligonucleotide
agcugcaggcagcacagac

SEQ ID NO: 564 - RNA, 19 nt, Artificial Sequence
  Description of Artificial Sequence: Synthetic oligonucleotide
gcugcaggcagcacagacg

SEQ ID NO: 565 - RNA, 19 nt, Artificial Sequence
  Description of Artificial Sequence: Synthetic oligonucleotide
cugcaggcagcacagacgg

SEQ ID NO: 566 - RNA, 19 nt, Artificial Sequence
  Description of Artificial Sequence: Synthetic oligonucleotide
ugcaggcagcacagacggu

SEQ ID NO: 567 - RNA, 19 nt, Artificial Sequence
  Description of Artificial Sequence: Synthetic oligonucleotide
gcaggcagcacagacgguc

SEQ ID NO: 568 - RNA, 19 nt, Artificial Sequence
  Description of Artificial Sequence: Synthetic oligonucleotide
caggcagcacagacgguca

SEQ ID NO: 569 - RNA, 19 nt, Artificial Sequence
  Description of Artificial Sequence: Synthetic oligonucleotide
aggcagcacagacggucac

SEQ ID NO: 570 - RNA, 19 nt, Artificial Sequence
  Description of Artificial Sequence: Synthetic oligonucleotide
ggcagcacagacggucacu

SEQ ID NO: 571 - RNA, 19 nt, Artificial Sequence
  Description of Artificial Sequence: Synthetic oligonucleotide
gcagcacagacggucacuc

SEQ ID NO: 572 - RNA, 19 nt, Artificial Sequence
  Description of Artificial Sequence: Synthetic oligonucleotide
cagcacagacggucacuca

SEQ ID NO: 573 - RNA, 19 nt, Artificial Sequence
  Description of Artificial Sequence: Synthetic oligonucleotide
agcacagacggucacucag

SEQ ID NO: 574 - RNA, 19 nt, Artificial Sequence
  Description of Artificial Sequence: Synthetic oligonucleotide
gcacagacggucacucaga

SEQ ID NO: 575 - RNA, 19 nt, Artificial Sequence
  Description of Artificial Sequence: Synthetic oligonucleotide
cacagacggucacucagac

SEQ ID NO: 576 - RNA, 19 nt, Artificial Sequence
  Description of Artificial Sequence: Synthetic oligonucleotide
acagacggucacucagacc

SEQ ID NO: 577 - RNA, 19 nt, Artificial Sequence
  Description of Artificial Sequence: Synthetic oligonucleotide
cagacggucacucagaccu

SEQ ID NO: 578 - RNA, 19 nt, Artificial Sequence
  Description of Artificial Sequence: Synthetic oligonucleotide
agacggucacucagaccuc

SEQ ID NO: 579 - RNA, 19 nt, Artificial Sequence
  Description of Artificial Sequence: Synthetic oligonucleotide
gacggucacucagaccucc

SEQ ID NO: 580 - RNA, 19 nt, Artificial Sequence
  Description of Artificial Sequence: Synthetic oligonucleotide
acggucacucagaccuccg

SEQ ID NO: 581 - RNA, 19 nt, Artificial Sequence
  Description of Artificial Sequence: Synthetic oligonucleotide
cggucacucagaccuccgc

SEQ ID NO: 582 - RNA, 19 nt, Artificial Sequence
  Description of Artificial Sequence: Synthetic oligonucleotide
ggucacucagaccuccgca

SEQ ID NO: 583 - RNA, 19 nt, Artificial Sequence
  Description of Artificial Sequence: Synthetic oligonucleotide
gucacucagaccuccgcag

SEQ ID NO: 584 - RNA, 19 nt, Artificial Sequence
  Description of Artificial Sequence: Synthetic oligonucleotide
ucacucagaccuccgcaga

SEQ ID NO: 585 - RNA, 19 nt, Artificial Sequence
  Description of Artificial Sequence: Synthetic oligonucleotide
cacucagaccuccgcagau

SEQ ID NO: 586 - RNA, 19 nt, Artificial Sequence
  Description of Artificial Sequence: Synthetic oligonucleotide
acucagaccuccgcagaug

SEQ ID NO: 587 - RNA, 19 nt, Artificial Sequence
  Description of Artificial Sequence: Synthetic oligonucleotide
cucagaccuccgcagaugc

SEQ ID NO: 588 - RNA, 19 nt, Artificial Sequence
  Description of Artificial Sequence: Synthetic oligonucleotide
ucagaccuccgcagaugcc

SEQ ID NO: 589 - RNA, 19 nt, Artificial Sequence
  Description of Artificial Sequence: Synthetic oligonucleotide
cagaccuccgcagaugcca

SEQ ID NO: 590 - RNA, 19 nt, Artificial Sequence
  Description of Artificial Sequence: Synthetic oligonucleotide
agaccuccgcagaugccau

SEQ ID NO: 591 - RNA, 19 nt, Artificial Sequence
  Description of Artificial Sequence: Synthetic oligonucleotide
gaccuccgcagaugccauc

SEQ ID NO: 592 - RNA, 19 nt, Artificial Sequence
  Description of Artificial Sequence: Synthetic oligonucleotide
accuccgcagaugccaucu

SEQ ID NO: 593 - RNA, 19 nt, Artificial Sequence
  Description of Artificial Sequence: Synthetic oligonucleotide
ccuccgcagaugccaucua

SEQ ID NO: 594 - RNA, 19 nt, Artificial Sequence
  Description of Artificial Sequence: Synthetic oligonucleotide
cuccgcagaugccaucuac

SEQ ID NO: 595 - RNA, 19 nt, Artificial Sequence
  Description of Artificial Sequence: Synthetic oligonucleotide
uccgcagaugccaucuacg

SEQ ID NO: 596 - RNA, 19 nt, Artificial Sequence
  Description of Artificial Sequence: Synthetic oligonucleotide
ccgcagaugccaucuacga

SEQ ID NO: 597 - RNA, 19 nt, Artificial Sequence
  Description of Artificial Sequence: Synthetic oligonucleotide
cgcagaugccaucuacgac

SEQ ID NO: 598 - RNA, 19 nt, Artificial Sequence
  Description of Artificial Sequence: Synthetic oligonucleotide
gcagaugccaucuacgacu

SEQ ID NO: 599 - RNA, 19 nt, Artificial Sequence
  Description of Artificial Sequence: Synthetic oligonucleotide
cagaugccaucuacgacug

SEQ ID NO: 600 - RNA, 19 nt, Artificial Sequence
  Description of Artificial Sequence: Synthetic oligonucleotide
agaugccaucuacgacugc

SEQ ID NO: 601 - RNA, 19 nt, Artificial Sequence
  Description of Artificial Sequence: Synthetic oligonucleotide
gaugccaucuacgacugcu

SEQ ID NO: 602 - RNA, 19 nt, Artificial Sequence
  Description of Artificial Sequence: Synthetic oligonucleotide
augccaucuacgacugcuc

SEQ ID NO: 603 - RNA, 19 nt, Artificial Sequence
  Description of Artificial Sequence: Synthetic oligonucleotide
ugccaucuacgacugcucu

SEQ ID NO: 604 - RNA, 19 nt, Artificial Sequence
  Description of Artificial Sequence: Synthetic oligonucleotide
gccaucuacgacugcucuu

SEQ ID NO: 605 - RNA, 19 nt, Artificial Sequence
  Description of Artificial Sequence: Synthetic oligonucleotide
ccaucuacgacugcucuuc

SEQ ID NO: 606 - RNA, 19 nt, Artificial Sequence
  Description of Artificial Sequence: Synthetic oligonucleotide
caucuacgacugcucuucc

SEQ ID NO: 607 - RNA, 19 nt, Artificial Sequence
  Description of Artificial Sequence: Synthetic oligonucleotide
aucuacgacugcucuuccc

SEQ ID NO: 608 - RNA, 19 nt, Artificial Sequence
  Description of Artificial Sequence: Synthetic oligonucleotide
ucuacgacugcucuucccu

SEQ ID NO: 609 - RNA, 19 nt, Artificial Sequence
  Description of Artificial Sequence: Synthetic oligonucleotide
cuacgacugcucuucccuc

SEQ ID NO: 610 - RNA, 19 nt, Artificial Sequence
  Description of Artificial Sequence: Synthetic oligonucleotide
uacgacugcucuucccucu

SEQ ID NO: 611 - RNA, 19 nt, Artificial Sequence
  Description of Artificial Sequence: Synthetic oligonucleotide
acgacugcucuucccucua

SEQ ID NO: 612 - RNA, 19 nt, Artificial Sequence
  Description of Artificial Sequence: Synthetic oligonucleotide
cgacugcucuucccucuac

SEQ ID NO: 613 - RNA, 19 nt, Artificial Sequence
  Description of Artificial Sequence: Synthetic oligonucleotide
gacugcucuucccucuacc

SEQ ID NO: 614 - RNA, 19 nt, Artificial Sequence
  Description of Artificial Sequence: Synthetic oligonucleotide
acugcucuucccucuacca

SEQ ID NO: 615 - RNA, 19 nt, Artificial Sequence
  Description of Artificial Sequence: Synthetic oligonucleotide
cugcucuucccucuaccag

SEQ ID NO: 616 - RNA, 19 nt, Artificial Sequence
  Description of Artificial Sequence: Synthetic oligonucleotide
ugcucuucccucuaccaga

SEQ ID NO: 617 - RNA, 19 nt, Artificial Sequence
  Description of Artificial Sequence: Synthetic oligonucleotide
gcucuucccucuaccagaa

SEQ ID NO: 618 - RNA, 19 nt, Artificial Sequence
  Description of Artificial Sequence: Synthetic oligonucleotide
cucuucccucuaccagaag

SEQ ID NO: 619 - RNA, 19 nt, Artificial Sequence
  Description of Artificial Sequence: Synthetic oligonucleotide
ucuucccucuaccagaaga

SEQ ID NO: 620 - RNA, 19 nt, Artificial Sequence
  Description of Artificial Sequence: Synthetic oligonucleotide
cuucccucuaccagaagaa

SEQ ID NO: 621 - RNA, 19 nt, Artificial Sequence
  Description of Artificial Sequence: Synthetic oligonucleotide
uucccucuaccagaagaac

SEQ ID NO: 622 - RNA, 19 nt, Artificial Sequence
  Description of Artificial Sequence: Synthetic oligonucleotide
ucccucuaccagaagaacu

SEQ ID NO: 623 - RNA, 19 nt, Artificial Sequence
  Description of Artificial Sequence: Synthetic oligonucleotide
cccucuaccagaagaacua

SEQ ID NO: 624 - RNA, 19 nt, Artificial Sequence
  Description of Artificial Sequence: Synthetic oligonucleotide
ccucuaccagaagaacuac

SEQ ID NO: 625 - RNA, 19 nt, Artificial Sequence
  Description of Artificial Sequence: Synthetic oligonucleotide
cucuaccagaagaacuacc

SEQ ID NO: 626 - RNA, 19 nt, Artificial Sequence
  Description of Artificial Sequence: Synthetic oligonucleotide
ucuaccagaagaacuaccg

SEQ ID NO: 627 - RNA, 19 nt, Artificial Sequence
  Description of Artificial Sequence: Synthetic oligonucleotide
cuaccagaagaacuaccgc

SEQ ID NO: 628 - RNA, 19 nt, Artificial Sequence
  Description of Artificial Sequence: Synthetic oligonucleotide
uaccagaagaacuaccgca

SEQ ID NO: 629 - RNA, 19 nt, Artificial Sequence
  Description of Artificial Sequence: Synthetic oligonucleotide
accagaagaacuaccgcau

SEQ ID NO: 630 - RNA, 19 nt, Artificial Sequence
  Description of Artificial Sequence: Synthetic oligonucleotide
ccagaagaacuaccgcauc

SEQ ID NO: 631 - RNA, 19 nt, Artificial Sequence
  Description of Artificial Sequence: Synthetic oligonucleotide
cagaagaacuaccgcaucu

SEQ ID NO: 632 - RNA, 19 nt, Artificial Sequence
  Description of Artificial Sequence: Synthetic oligonucleotide
agaagaacuaccgcaucuc

SEQ ID NO: 633 - RNA, 19 nt, Artificial Sequence
  Description of Artificial Sequence: Synthetic oligonucleotide
gaagaacuaccgcaucucu

SEQ ID NO: 634 - RNA, 19 nt, Artificial Sequence
  Description of Artificial Sequence: Synthetic oligonucleotide
aagaacuaccgcaucucug

SEQ ID NO: 635 - RNA, 19 nt, Artificial Sequence
  Description of Artificial Sequence: Synthetic oligonucleotide
agaacuaccgcaucucugg

SEQ ID NO: 636 - RNA, 19 nt, Artificial Sequence
  Description of Artificial Sequence: Synthetic oligonucleotide
gaacuaccgcaucucugga

SEQ ID NO: 637 - RNA, 19 nt, Artificial Sequence
  Description of Artificial Sequence: Synthetic oligonucleotide
aacuaccgcaucucuggag

SEQ ID NO: 638 - RNA, 19 nt, Artificial Sequence
  Description of Artificial Sequence: Synthetic oligonucleotide
acuaccgcaucucuggagu

SEQ ID NO: 639 - RNA, 19 nt, Artificial Sequence
  Description of Artificial Sequence: Synthetic oligonucleotide
cuaccgcaucucuggagug

SEQ ID NO: 640 - RNA, 19 nt, Artificial Sequence
  Description of Artificial Sequence: Synthetic oligonucleotide
uaccgcaucucuggagugu

SEQ ID NO: 641 - RNA, 19 nt, Artificial Sequence
  Description of Artificial Sequence: Synthetic oligonucleotide
accgcaucucuggagugua

SEQ ID NO: 642 - RNA, 19 nt, Artificial Sequence
  Description of Artificial Sequence: Synthetic oligonucleotide
ccgcaucucuggaguguau

SEQ ID NO: 643 - RNA, 19 nt, Artificial Sequence
  Description of Artificial Sequence: Synthetic oligonucleotide
cgcaucucuggaguguaua

SEQ ID NO: 644 - RNA, 19 nt, Artificial Sequence
  Description of Artificial Sequence: Synthetic oligonucleotide
gcaucucuggaguguauaa

SEQ ID NO: 645 - RNA, 19 nt, Artificial Sequence
  Description of Artificial Sequence: Synthetic oligonucleotide
caucucuggaguguauaag

SEQ ID NO: 646 - RNA, 19 nt, Artificial Sequence
  Description of Artificial Sequence: Synthetic oligonucleotide
aucucuggaguguauaagc

SEQ ID NO: 647 - RNA, 19 nt, Artificial Sequence
  Description of Artificial Sequence: Synthetic oligonucleotide
ucucuggaguguauaagcu

SEQ ID NO: 648 - RNA, 19 nt, Artificial Sequence
  Description of Artificial Sequence: Synthetic oligonucleotide
cucuggaguguauaagcuu

SEQ ID NO: 649 - RNA, 19 nt, Artificial Sequence
  Description of Artificial Sequence: Synthetic oligonucleotide
ucuggaguguauaagcuuc

SEQ ID NO: 650 - RNA, 19 nt, Artificial Sequence
  Description of Artificial Sequence: Synthetic oligonucleotide
cuggaguguauaagcuucc

SEQ ID NO: 651 - RNA, 19 nt, Artificial Sequence
  Description of Artificial Sequence: Synthetic oligonucleotide
uggaguguauaagcuuccu

SEQ ID NO: 652 - RNA, 19 nt, Artificial Sequence
  Description of Artificial Sequence: Synthetic oligonucleotide
ggaguguauaagcuuccuc

SEQ ID NO: 653 - RNA, 19 nt, Artificial Sequence
  Description of Artificial Sequence: Synthetic oligonucleotide
gaguguauaagcuuccucc

SEQ ID NO: 654 - RNA, 19 nt, Artificial Sequence
  Description of Artificial Sequence: Synthetic oligonucleotide
aguguauaagcuuccuccu

SEQ ID NO: 655 - RNA, 19 nt, Artificial Sequence
  Description of Artificial Sequence: Synthetic oligonucleotide
guguauaagcuuccuccug

SEQ ID NO: 656 - RNA, 19 nt, Artificial Sequence
  Description of Artificial Sequence: Synthetic oligonucleotide
uguauaagcuuccuccuga

SEQ ID NO: 657 - RNA, 19 nt, Artificial Sequence
  Description of Artificial Sequence: Synthetic oligonucleotide
guauaagcuuccuccugau

SEQ ID NO: 658 - RNA, 19 nt, Artificial Sequence
  Description of Artificial Sequence: Synthetic oligonucleotide
uauaagcuuccuccugaug

SEQ ID NO: 659 - RNA, 19 nt, Artificial Sequence
  Description of Artificial Sequence: Synthetic oligonucleotide
auaagcuuccuccugauga

SEQ ID NO: 660 - RNA, 19 nt, Artificial Sequence
  Description of Artificial Sequence: Synthetic oligonucleotide
uaagcuuccuccugaugac

SEQ ID NO: 661 - RNA, 19 nt, Artificial Sequence
  Description of Artificial Sequence: Synthetic oligonucleotide
aagcuuccuccugaugacu

SEQ ID NO: 662 - RNA, 19 nt, Artificial Sequence
  Description of Artificial Sequence: Synthetic oligonucleotide
agcuuccuccugaugacuu

SEQ ID NO: 663 - RNA, 19 nt, Artificial Sequence
  Description of Artificial Sequence: Synthetic oligonucleotide
gcuuccuccugaugacuuc

SEQ ID NO: 664 - RNA, 19 nt, Artificial Sequence
  Description of Artificial Sequence: Synthetic oligonucleotide
cuuccuccugaugacuucc

SEQ ID NO: 665 - RNA, 19 nt, Artificial Sequence
  Description of Artificial Sequence: Synthetic oligonucleotide
uuccuccugaugacuuccu

SEQ ID NO: 666 - RNA, 19 nt, Artificial Sequence
  Description of Artificial Sequence: Synthetic oligonucleotide
uccuccugaugacuuccug

SEQ ID NO: 667 - RNA, 19 nt, Artificial Sequence
  Description of Artificial Sequence: Synthetic oligonucleotide
ccuccugaugacuuccugg

SEQ ID NO: 668 - RNA, 19 nt, Artificial Sequence
  Description of Artificial Sequence: Synthetic oligonucleotide
cuccugaugacuuccuggg

SEQ ID NO: 669 - RNA, 19 nt, Artificial Sequence
  Description of Artificial Sequence: Synthetic oligonucleotide
uccugaugacuuccugggc

SEQ ID NO: 670 - RNA, 19 nt, Artificial Sequence
  Description of Artificial Sequence: Synthetic oligonucleotide
ccugaugacuuccugggca

SEQ ID NO: 671 - RNA, 19 nt, Artificial Sequence
  Description of Artificial Sequence: Synthetic oligonucleotide
cugaugacuuccugggcag

SEQ ID NO: 672 - RNA, 19 nt, Artificial Sequence
  Description of Artificial Sequence: Synthetic oligonucleotide
ugaugacuuccugggcagc

SEQ ID NO: 673 - RNA, 19 nt, Artificial Sequence
  Description of Artificial Sequence: Synthetic oligonucleotide
gaugacuuccugggcagcc

SEQ ID NO: 674 - RNA, 19 nt, Artificial Sequence
  Description of Artificial Sequence: Synthetic oligonucleotide
augacuuccugggcagccc

SEQ ID NO: 675 - RNA, 19 nt, Artificial Sequence
  Description of Artificial Sequence: Synthetic oligonucleotide
ugacuuccugggcagcccu

SEQ ID NO: 676 - RNA, 19 nt, Artificial Sequence
  Description of Artificial Sequence: Synthetic oligonucleotide
gacuuccugggcagcccug

SEQ ID NO: 677 - RNA, 19 nt, Artificial Sequence
  Description of Artificial Sequence: Synthetic oligonucleotide
acuuccugggcagcccuga

SEQ ID NO: 678 - RNA, 19 nt, Artificial Sequence
  Description of Artificial Sequence: Synthetic oligonucleotide
cuuccugggcagcccugaa

SEQ ID NO: 679 - RNA, 19 nt, Artificial Sequence
  Description of Artificial Sequence: Synthetic oligonucleotide
uuccugggcagcccugaac

SEQ ID NO: 680 - RNA, 19 nt, Artificial Sequence
  Description of Artificial Sequence: Synthetic oligonucleotide
uccugggcagcccugaacu

SEQ ID NO: 681 - RNA, 19 nt, Artificial Sequence
  Description of Artificial Sequence: Synthetic oligonucleotide
ccugggcagcccugaacug

SEQ ID NO: 682 - RNA, 19 nt, Artificial Sequence
  Description of Artificial Sequence: Synthetic oligonucleotide
cugggcagcccugaacugg

SEQ ID NO: 683 - RNA, 19 nt, Artificial Sequence
  Description of Artificial Sequence: Synthetic oligonucleotide
ugggcagcccugaacugga

SEQ ID NO: 684 - RNA, 19 nt, Artificial Sequence
  Description of Artificial Sequence: Synthetic oligonucleotide
gggcagcccugaacuggag

SEQ ID NO: 685 - RNA, 19 nt, Artificial Sequence
  Description of Artificial Sequence: Synthetic oligonucleotide
ggcagcccugaacuggagg

SEQ ID NO: 686 - RNA, 19 nt, Artificial Sequence
  Description of Artificial Sequence: Synthetic oligonucleotide
gcagcccugaacuggaggu

SEQ ID NO: 687 - RNA, 19 nt, Artificial Sequence
  Description of Artificial Sequence: Synthetic oligonucleotide
cagcccugaacuggaggug

SEQ ID NO: 688 - RNA, 19 nt, Artificial Sequence
  Description of Artificial Sequence: Synthetic oligonucleotide
agcccugaacuggaggugu

SEQ ID NO: 689 - RNA, 19 nt, Artificial Sequence
  Description of Artificial Sequence: Synthetic oligonucleotide
gcccugaacuggagguguu

SEQ ID NO: 690 - RNA, 19 nt, Artificial Sequence
  Description of Artificial Sequence: Synthetic oligonucleotide
cccugaacuggagguguuc

SEQ ID NO: 691 - RNA, 19 nt, Artificial Sequence
  Description of Artificial Sequence: Synthetic oligonucleotide
ccugaacuggagguguucu

SEQ ID NO: 692 - RNA, 19 nt, Artificial Sequence
  Description of Artificial Sequence: Synthetic oligonucleotide
cugaacuggagguguucug

SEQ ID NO: 693 - RNA, 19 nt, Artificial Sequence
  Description of Artificial Sequence: Synthetic oligonucleotide
ugaacuggagguguucugu

SEQ ID NO: 694 - RNA, 19 nt, Artificial Sequence
  Description of Artificial Sequence: Synthetic oligonucleotide
gaacuggagguguucugug

SEQ ID NO: 695 - RNA, 19 nt, Artificial Sequence
  Description of Artificial Sequence: Synthetic oligonucleotide
aacuggagguguucuguga

SEQ ID NO: 696 - RNA, 19 nt, Artificial Sequence
  Description of Artificial Sequence: Synthetic oligonucleotide
acuggagguguucugugac

SEQ ID NO: 697 - RNA, 19 nt, Artificial Sequence
  Description of Artificial Sequence: Synthetic oligonucleotide
cuggagguguucugugaca

SEQ ID NO: 698 - RNA, 19 nt, Artificial Sequence
  Description of Artificial Sequence: Synthetic oligonucleotide
uggagguguucugugacau

SEQ ID NO: 699 - RNA, 19 nt, Artificial Sequence
  Description of Artificial Sequence: Synthetic oligonucleotide
ggagguguucugugacaug

SEQ ID NO: 700 - RNA, 19 nt, Artificial Sequence
  Description of Artificial Sequence: Synthetic oligonucleotide
gagguguucugugacaugg

SEQ ID NO: 701 - RNA, 19 nt, Artificial Sequence
  Description of Artificial Sequence: Synthetic oligonucleotide
agguguucugugacaugga

SEQ ID NO: 702 - RNA, 19 nt, Artificial Sequence
  Description of Artificial Sequence: Synthetic oligonucleotide
gguguucugugacauggag

SEQ ID NO: 703 - RNA, 19 nt, Artificial Sequence
  Description of Artificial Sequence: Synthetic oligonucleotide
guguucugugacauggaga

SEQ ID NO: 704 - RNA, 19 nt, Artificial Sequence
  Description of Artificial Sequence: Synthetic oligonucleotide
uguucugugacauggagac

SEQ ID NO: 705 - RNA, 19 nt, Artificial Sequence
  Description of Artificial Sequence: Synthetic oligonucleotide
guucugugacauggagacu

SEQ ID NO: 706 - RNA, 19 nt, Artificial Sequence
  Description of Artificial Sequence: Synthetic oligonucleotide
uucugugacauggagacuu

SEQ ID NO: 707 - RNA, 19 nt, Artificial Sequence
  Description of Artificial Sequence: Synthetic oligonucleotide
ucugugacauggagacuuc

SEQ ID NO: 708 - RNA, 19 nt, Artificial Sequence
  Description of Artificial Sequence: Synthetic oligonucleotide
cugugacauggagacuuca

SEQ ID NO: 709 - RNA, 19 nt, Artificial Sequence
  Description of Artificial Sequence: Synthetic oligonucleotide
ugugacauggagacuucag

SEQ ID NO: 710 - RNA, 19 nt, Artificial Sequence
  Description of Artificial Sequence: Synthetic oligonucleotide
gugacauggagacuucagg

SEQ ID NO: 711 - RNA, 19 nt, Artificial Sequence
  Description of Artificial Sequence: Synthetic oligonucleotide
ugacauggagacuucaggc

SEQ ID NO: 712 - RNA, 19 nt, Artificial Sequence
  Description of Artificial Sequence: Synthetic oligonucleotide
gacauggagacuucaggcg

SEQ ID NO: 713 - RNA, 19 nt, Artificial Sequence
  Description of Artificial Sequence: Synthetic oligonucleotide
acauggagacuucaggcgg

SEQ ID NO: 714 - RNA, 19 nt, Artificial Sequence
  Description of Artificial Sequence: Synthetic oligonucleotide
cauggagacuucaggcgga

SEQ ID NO: 715 - RNA, 19 nt, Artificial Sequence
  Description of Artificial Sequence: Synthetic oligonucleotide
auggagacuucaggcggag

SEQ ID NO: 716 - RNA, 19 nt, Artificial Sequence
  Description of Artificial Sequence: Synthetic oligonucleotide
uggagacuucaggcggagg

SEQ ID NO: 717 - RNA, 19 nt, Artificial Sequence
  Description of Artificial Sequence: Synthetic oligonucleotide
ggagacuucaggcggaggc

SEQ ID NO: 718 - RNA, 19 nt, Artificial Sequence
  Description of Artificial Sequence: Synthetic oligonucleotide
gagacuucaggcggaggcu

SEQ ID NO: 719 - RNA, 19 nt, Artificial Sequence
  Description of Artificial Sequence: Synthetic oligonucleotide
agacuucaggcggaggcug

SEQ ID NO: 720 - RNA, 19 nt, Artificial Sequence
  Description of Artificial Sequence: Synthetic oligonucleotide
gacuucaggcggaggcugg

SEQ ID NO: 721 - RNA, 19 nt, Artificial Sequence
  Description of Artificial Sequence: Synthetic oligonucleotide
acuucaggcggaggcugga

SEQ ID NO: 722 - RNA, 19 nt, Artificial Sequence
  Description of Artificial Sequence: Synthetic oligonucleotide
cuucaggcggaggcuggac

SEQ ID NO: 723 - RNA, 19 nt, Artificial Sequence
  Description of Artificial Sequence: Synthetic oligonucleotide
uucaggcggaggcuggacc

SEQ ID NO: 724 - RNA, 19 nt, Artificial Sequence
  Description of Artificial Sequence: Synthetic oligonucleotide
ucaggcggaggcuggacca

SEQ ID NO: 725 - RNA, 19 nt, Artificial Sequence
  Description of Artificial Sequence: Synthetic oligonucleotide
caggcggaggcuggaccau

SEQ ID NO: 726 - RNA, 19 nt, Artificial Sequence
  Description of Artificial Sequence: Synthetic oligonucleotide
aggcggaggcuggaccauc

SEQ ID NO: 727 - RNA, 19 nt, Artificial Sequence
  Description of Artificial Sequence: Synthetic oligonucleotide
ggcggaggcuggaccauca

SEQ ID NO: 728 - RNA, 19 nt, Artificial Sequence
  Description of Artificial Sequence: Synthetic oligonucleotide
gcggaggcuggaccaucau

SEQ ID NO: 729 - RNA, 19 nt, Artificial Sequence
  Description of Artificial Sequence: Synthetic oligonucleotide
cggaggcuggaccaucauc

SEQ ID NO: 730 - RNA, 19 nt, Artificial Sequence
  Description of Artificial Sequence: Synthetic oligonucleotide
ggaggcuggaccaucaucc

SEQ ID NO: 731 - RNA, 19 nt, Artificial Sequence
  Description of Artificial Sequence: Synthetic oligonucleotide
gaggcuggaccaucaucca

SEQ ID NO: 732 - RNA, 19 nt, Artificial Sequence
  Description of Artificial Sequence: Synthetic oligonucleotide
aggcuggaccaucauccag

SEQ ID NO: 733 - RNA, 19 nt, Artificial Sequence
  Description of Artificial Sequence: Synthetic oligonucleotide
ggcuggaccaucauccaga

SEQ ID NO: 734 - RNA, 19 nt, Artificial Sequence
  Description of Artificial Sequence: Synthetic oligonucleotide
gcuggaccaucauccagag

SEQ ID NO: 735 - RNA, 19 nt, Artificial Sequence
  Description of Artificial Sequence: Synthetic oligonucleotide
cuggaccaucauccagaga

SEQ ID NO: 736 - RNA, 19 nt, Artificial Sequence
  Description of Artificial Sequence: Synthetic oligonucleotide
uggaccaucauccagagac

SEQ ID NO: 737 - RNA, 19 nt, Artificial Sequence
  Description of Artificial Sequence: Synthetic oligonucleotide
ggaccaucauccagagacg

SEQ ID NO: 738 - RNA, 19 nt, Artificial Sequence
  Description of Artificial Sequence: Synthetic oligonucleotide
gaccaucauccagagacga

SEQ ID NO: 739 - RNA, 19 nt, Artificial Sequence
  Description of Artificial Sequence: Synthetic oligonucleotide
accaucauccagagacgaa

SEQ ID NO: 740 - RNA, 19 nt, Artificial Sequence
  Description of Artificial Sequence: Synthetic oligonucleotide
ccaucauccagagacgaaa

SEQ ID NO: 741 - RNA, 19 nt, Artificial Sequence
  Description of Artificial Sequence: Synthetic oligonucleotide
caucauccagagacgaaaa

SEQ ID NO: 742 - RNA, 19 nt, Artificial Sequence
  Description of Artificial Sequence: Synthetic oligonucleotide
aucauccagagacgaaaaa

SEQ ID NO: 743 - RNA, 19 nt, Artificial Sequence
  Description of Artificial Sequence: Synthetic oligonucleotide
ucauccagagacgaaaaag

SEQ ID NO: 744 - RNA, 19 nt, Artificial Sequence
  Description of Artificial Sequence: Synthetic oligonucleotide
cauccagagacgaaaaagu

SEQ ID NO: 745 - RNA, 19 nt, Artificial Sequence
  Description of Artificial Sequence: Synthetic oligonucleotide
auccagagacgaaaaagug

SEQ ID NO: 746 - RNA, 19 nt, Artificial Sequence
  Description of Artificial Sequence: Synthetic oligonucleotide
uccagagacgaaaaagugg

SEQ ID NO: 747 - RNA, 19 nt, Artificial Sequence
  Description of Artificial Sequence: Synthetic oligonucleotide
ccagagacgaaaaaguggc

SEQ ID NO: 748 - RNA, 19 nt, Artificial Sequence
  Description of Artificial Sequence: Synthetic oligonucleotide
cagagacgaaaaaguggcc

SEQ ID NO: 749 - RNA, 19 nt, Artificial Sequence
  Description of Artificial Sequence: Synthetic oligonucleotide
agagacgaaaaaguggccu

SEQ ID NO: 750 - RNA, 19 nt, Artificial Sequence
  Description of Artificial Sequence: Synthetic oligonucleotide
gagacgaaaaaguggccuu

SEQ ID NO: 751 - RNA, 19 nt, Artificial Sequence
  Description of Artificial Sequence: Synthetic oligonucleotide
agacgaaaaaguggccuug

SEQ ID NO: 752 - RNA, 19 nt, Artificial Sequence
  Description of Artificial Sequence: Synthetic oligonucleotide
gacgaaaaaguggccuugu

SEQ ID NO: 753 - RNA, 19 nt, Artificial Sequence
  Description of Artificial Sequence: Synthetic oligonucleotide
acgaaaaaguggccuuguc

SEQ ID NO: 754 - RNA, 19 nt, Artificial Sequence
  Description of Artificial Sequence: Synthetic oligonucleotide
cgaaaaaguggccuugucu

SEQ ID NO: 755 - RNA, 19 nt, Artificial Sequence
  Description of Artificial Sequence: Synthetic oligonucleotide
gaaaaaguggccuugucuc

SEQ ID NO: 756 - RNA, 19 nt, Artificial Sequence
  Description of Artificial Sequence: Synthetic oligonucleotide
aaaaaguggccuugucucc

SEQ ID NO: 757 - RNA, 19 nt, Artificial Sequence
  Description of Artificial Sequence: Synthetic oligonucleotide
aaaaguggccuugucuccu

SEQ ID NO: 758 - RNA, 19 nt, Artificial Sequence
  Description of Artificial Sequence: Synthetic oligonucleotide
aaaguggccuugucuccuu

SEQ ID NO: 759 - RNA, 19 nt, Artificial Sequence
  Description of Artificial Sequence: Synthetic oligonucleotide
aaguggccuugucuccuuc

SEQ ID NO: 760 - RNA, 19 nt, Artificial Sequence
  Description of Artificial Sequence: Synthetic oligonucleotide
aguggccuugucuccuucu

SEQ ID NO: 761 - RNA, 19 nt, Artificial Sequence
  Description of Artificial Sequence: Synthetic oligonucleotide
guggccuugucuccuucua

SEQ ID NO: 762 - RNA, 19 nt, Artificial Sequence
  Description of Artificial Sequence: Synthetic oligonucleotide
uggccuugucuccuucuac

SEQ ID NO: 763 - RNA, 19 nt, Artificial Sequence
  Description of Artificial Sequence: Synthetic oligonucleotide
ggccuugucuccuucuacc

SEQ ID NO: 764 - RNA, 19 nt, Artificial Sequence
  Description of Artificial Sequence: Synthetic oligonucleotide
gccuugucuccuucuaccg

SEQ ID NO: 765 - RNA, 19 nt, Artificial Sequence
  Description of Artificial Sequence: Synthetic oligonucleotide
ccuugucuccuucuaccgg

SEQ ID NO: 766 - RNA, 19 nt, Artificial Sequence
  Description of Artificial Sequence: Synthetic oligonucleotide
cuugucuccuucuaccggg

SEQ ID NO: 767 - RNA, 19 nt, Artificial Sequence
  Description of Artificial Sequence: Synthetic oligonucleotide
uugucuccuucuaccggga

SEQ ID NO: 768 - RNA, 19 nt, Artificial Sequence
  Description of Artificial Sequence: Synthetic oligonucleotide
ugucuccuucuaccgggac

SEQ ID NO: 769 - RNA, 19 nt, Artificial Sequence
  Description of Artificial Sequence: Synthetic oligonucleotide
gucuccuucuaccgggacu

SEQ ID NO: 770 - RNA, 19 nt, Artificial Sequence
  Description of Artificial Sequence: Synthetic oligonucleotide
ucuccuucuaccgggacug

SEQ ID NO: 771 - RNA, 19 nt, Artificial Sequence
  Description of Artificial Sequence: Synthetic oligonucleotide
cuccuucuaccgggacugg

SEQ ID NO: 772 - RNA, 19 nt, Artificial Sequence
  Description of Artificial Sequence: Synthetic oligonucleotide
uccuucuaccgggacugga

SEQ ID NO: 773 - RNA, 19 nt, Artificial Sequence
  Description of Artificial Sequence: Synthetic oligonucleotide
ccuucuaccgggacuggaa

SEQ ID NO: 774 - RNA, 19 nt, Artificial Sequence
  Description of Artificial Sequence: Synthetic oligonucleotide
cuucuaccgggacuggaag

SEQ ID NO: 775 - RNA, 19 nt, Artificial Sequence
  Description of Artificial Sequence: Synthetic oligonucleotide
uucuaccgggacuggaagc

SEQ ID NO: 776 - RNA, 19 nt, Artificial Sequence
  Description of Artificial Sequence: Synthetic oligonucleotide
ucuaccgggacuggaagca

SEQ ID NO: 777 - RNA, 19 nt, Artificial Sequence
  Description of Artificial Sequence: Synthetic oligonucleotide
cuaccgggacuggaagcag

SEQ ID NO: 778 - RNA, 19 nt, Artificial Sequence
  Description of Artificial Sequence: Synthetic oligonucleotide
uaccgggacuggaagcagu

SEQ ID NO: 779 - RNA, 19 nt, Artificial Sequence
  Description of Artificial Sequence: Synthetic oligonucleotide
accgggacuggaagcagua

SEQ ID NO: 780 - RNA, 19 nt, Artificial Sequence
  Description of Artificial Sequence: Synthetic oligonucleotide
ccgggacuggaagcaguac

SEQ ID NO: 781 - RNA, 19 nt, Artificial Sequence
  Description of Artificial Sequence: Synthetic oligonucleotide
cgggacuggaagcaguaca

SEQ ID NO: 782 - RNA, 19 nt, Artificial Sequence
  Description of Artificial Sequence: Synthetic oligonucleotide
gggacuggaagcaguacaa

SEQ ID NO: 783 - RNA, 19 nt, Artificial Sequence
  Description of Artificial Sequence: Synthetic oligonucleotide
ggacuggaagcaguacaag

SEQ ID NO: 784 - RNA, 19 nt, Artificial Sequence
  Description of Artificial Sequence: Synthetic oligonucleotide
gacuggaagcaguacaagc

SEQ ID NO: 785 - RNA, 19 nt, Artificial Sequence
  Description of Artificial Sequence: Synthetic oligonucleotide
acuggaagcaguacaagca

SEQ ID NO: 786 - RNA, 19 nt, Artificial Sequence
  Description of Artificial Sequence: Synthetic oligonucleotide
cuggaagcaguacaagcag

SEQ ID NO: 787 - RNA, 19 nt, Artificial Sequence
  Description of Artificial Sequence: Synthetic oligonucleotide
uggaagcaguacaagcagg

SEQ ID NO: 788 - RNA, 19 nt, Artificial Sequence
  Description of Artificial Sequence: Synthetic oligonucleotide
ggaagcaguacaagcaggg

SEQ ID NO: 789 - RNA, 19 nt, Artificial Sequence
  Description of Artificial Sequence: Synthetic oligonucleotide
gaagcaguacaagcagggc

SEQ ID NO: 790 - RNA, 19 nt, Artificial Sequence
  Description of Artificial Sequence: Synthetic oligonucleotide
aagcaguacaagcagggcu

SEQ ID NO: 791 - RNA, 19 nt, Artificial Sequence
  Description of Artificial Sequence: Synthetic oligonucleotide
agcaguacaagcagggcuu

SEQ ID NO: 792 - RNA, 19 nt, Artificial Sequence
  Description of Artificial Sequence: Synthetic oligonucleotide
gcaguacaagcagggcuuu

SEQ ID NO: 793 - RNA, 19 nt, Artificial Sequence
  Description of Artificial Sequence: Synthetic oligonucleotide
caguacaagcagggcuuug

SEQ ID NO: 794 - RNA, 19 nt, Artificial Sequence
  Description of Artificial Sequence: Synthetic oligonucleotide
aguacaagcagggcuuugg

SEQ ID NO: 795 - RNA, 19 nt, Artificial Sequence
  Description of Artificial Sequence: Synthetic oligonucleotide
guacaagcagggcuuuggc

SEQ ID NO: 796 - RNA, 19 nt, Artificial Sequence
  Description of Artificial Sequence: Synthetic oligonucleotide
uacaagcagggcuuuggca

SEQ ID NO: 797 - RNA, 19 nt, Artificial Sequence
  Description of Artificial Sequence: Synthetic oligonucleotide
acaagcagggcuuuggcag

SEQ ID NO: 798 - RNA, 19 nt, Artificial Sequence
  Description of Artificial Sequence: Synthetic oligonucleotide
caagcagggcuuuggcagc

SEQ ID NO: 799 - RNA, 19 nt, Artificial Sequence
  Description of Artificial Sequence: Synthetic oligonucleotide
aagcagggcuuuggcagca

SEQ ID NO: 800 - RNA, 19 nt, Artificial Sequence
  Description of Artificial Sequence: Synthetic oligonucleotide
agcagggcuuuggcagcau

SEQ ID NO: 801 - RNA, 19 nt, Artificial Sequence
  Description of Artificial Sequence: Synthetic oligonucleotide
gcagggcuuuggcagcauc

SEQ ID NO: 802 - RNA, 19 nt, Artificial Sequence
  Description of Artificial Sequence: Synthetic oligonucleotide
cagggcuuuggcagcaucc

SEQ ID NO: 803 - RNA, 19 nt, Artificial Sequence
  Description of Artificial Sequence: Synthetic oligonucleotide
agggcuuuggcagcauccg

SEQ ID NO: 804 - RNA, 19 nt, Artificial Sequence
  Description of Artificial Sequence: Synthetic oligonucleotide
gggcuuuggcagcauccgu

SEQ ID NO: 805 - RNA, 19 nt, Artificial Sequence
  Description of Artificial Sequence: Synthetic oligonucleotide
ggcuuuggcagcauccgug

SEQ ID NO: 806 - RNA, 19 nt, Artificial Sequence
  Description of Artificial Sequence: Synthetic oligonucleotide
gcuuuggcagcauccgugg

SEQ ID NO: 807 - RNA, 19 nt, Artificial Sequence
  Description of Artificial Sequence: Synthetic oligonucleotide
cuuuggcagcauccguggg

SEQ ID NO: 808 - RNA, 19 nt, Artificial Sequence
  Description of Artificial Sequence: Synthetic oligonucleotide
uuuggcagcauccgugggg

SEQ ID NO: 809 - RNA, 19 nt, Artificial Sequence
  Description of Artificial Sequence: Synthetic oligonucleotide
uuggcagcauccgugggga

SEQ ID NO: 810 - RNA, 19 nt, Artificial Sequence
  Description of Artificial Sequence: Synthetic oligonucleotide
uggcagcauccguggggac

SEQ ID NO: 811 - RNA, 19 nt, Artificial Sequence
  Description of Artificial Sequence: Synthetic oligonucleotide
ggcagcauccguggggacu

SEQ ID NO: 812 - RNA, 19 nt, Artificial Sequence
  Description of Artificial Sequence: Synthetic oligonucleotide
gcagcauccguggggacuu

SEQ ID NO: 813 - RNA, 19 nt, Artificial Sequence
  Description of Artificial Sequence: Synthetic oligonucleotide
cagcauccguggggacuuc

SEQ ID NO: 814 - RNA, 19 nt, Artificial Sequence
  Description of Artificial Sequence: Synthetic oligonucleotide
agcauccguggggacuucu

SEQ ID NO: 815 - RNA, 19 nt, Artificial Sequence
  Description of Artificial Sequence: Synthetic oligonucleotide
gcauccguggggacuucug

SEQ ID NO: 816 - RNA, 19 nt, Artificial Sequence
  Description of Artificial Sequence: Synthetic oligonucleotide
cauccguggggacuucugg

SEQ ID NO: 817 - RNA, 19 nt, Artificial Sequence
  Description of Artificial Sequence: Synthetic oligonucleotide
auccguggggacuucuggc

SEQ ID NO: 818 - RNA, 19 nt, Artificial Sequence
  Description of Artificial Sequence: Synthetic oligonucleotide
uccguggggacuucuggcu

SEQ ID NO: 819 - RNA, 19 nt, Artificial Sequence
  Description of Artificial Sequence: Synthetic oligonucleotide
ccguggggacuucuggcug

SEQ ID NO: 820 - RNA, 19 nt, Artificial Sequence
  Description of Artificial Sequence: Synthetic oligonucleotide
cguggggacuucuggcugg

SEQ ID NO: 821 - RNA, 19 nt, Artificial Sequence
  Description of Artificial Sequence: Synthetic oligonucleotide
guggggacuucuggcuggg

SEQ ID NO: 822 - RNA, 19 nt, Artificial Sequence
  Description of Artificial Sequence: Synthetic oligonucleotide
uggggacuucuggcugggg

SEQ ID NO: 823 - RNA, 19 nt, Artificial Sequence
  Description of Artificial Sequence: Synthetic oligonucleotide
ggggacuucuggcugggga

SEQ ID NO: 824 - RNA, 19 nt, Artificial Sequence
  Description of Artificial Sequence: Synthetic oligonucleotide
gggacuucuggcuggggaa

SEQ ID NO: 825 - RNA, 19 nt, Artificial Sequence
  Description of Artificial Sequence: Synthetic oligonucleotide
ggacuucuggcuggggaac

SEQ ID NO: 826 - RNA, 19 nt, Artificial Sequence
  Description of Artificial Sequence: Synthetic oligonucleotide
gacuucuggcuggggaacg

SEQ ID NO: 827 - RNA, 19 nt, Artificial Sequence
  Description of Artificial Sequence: Synthetic oligonucleotide
acuucuggcuggggaacga

SEQ ID NO: 828 - RNA, 19 nt, Artificial Sequence
  Description of Artificial Sequence: Synthetic oligonucleotide
cuucuggcuggggaacgaa

SEQ ID NO: 829 - RNA, 19 nt, Artificial Sequence
  Description of Artificial Sequence: Synthetic oligonucleotide
uucuggcuggggaacgaac

SEQ ID NO: 830 - RNA, 19 nt, Artificial Sequence
  Description of Artificial Sequence: Synthetic oligonucleotide
ucuggcuggggaacgaaca

SEQ ID NO: 831 - RNA, 19 nt, Artificial Sequence
  Description of Artificial Sequence: Synthetic oligonucleotide
cuggcuggggaacgaacac

SEQ ID NO: 832 - RNA, 19 nt, Artificial Sequence
  Description of Artificial Sequence: Synthetic oligonucleotide
uggcuggggaacgaacaca

SEQ ID NO: 833 - RNA, 19 nt, Artificial Sequence
  Description of Artificial Sequence: Synthetic oligonucleotide
ggcuggggaacgaacacau

SEQ ID NO: 834 - RNA, 19 nt, Artificial Sequence
  Description of Artificial Sequence: Synthetic oligonucleotide
gcuggggaacgaacacauc

SEQ ID NO: 835 - RNA, 19 nt, Artificial Sequence
  Description of Artificial Sequence: Synthetic oligonucleotide
cuggggaacgaacacaucc

SEQ ID NO: 836 - RNA, 19 nt, Artificial Sequence
  Description of Artificial Sequence: Synthetic oligonucleotide
uggggaacgaacacaucca

SEQ ID NO: 837 - RNA, 19 nt, Artificial Sequence
  Description of Artificial Sequence: Synthetic oligonucleotide
ggggaacgaacacauccac

SEQ ID NO: 838 - RNA, 19 nt, Artificial Sequence
  Description of Artificial Sequence: Synthetic oligonucleotide
gggaacgaacacauccacc

SEQ ID NO: 839 - RNA, 19 nt, Artificial Sequence
  Description of Artificial Sequence: Synthetic oligonucleotide
ggaacgaacacauccaccg

SEQ ID NO: 840 - RNA, 19 nt, Artificial Sequence
  Description of Artificial Sequence: Synthetic oligonucleotide
gaacgaacacauccaccgg

SEQ ID NO: 841 - RNA, 19 nt, Artificial Sequence
  Description of Artificial Sequence: Synthetic oligonucleotide
aacgaacacauccaccggc

SEQ ID NO: 842 - RNA, 19 nt, Artificial Sequence
  Description of Artificial Sequence: Synthetic oligonucleotide
acgaacacauccaccggcu

SEQ ID NO: 843 - RNA, 19 nt, Artificial Sequence
  Description of Artificial Sequence: Synthetic oligonucleotide
cgaacacauccaccggcuc

SEQ ID NO: 844 - RNA, 19 nt, Artificial Sequence
  Description of Artificial Sequence: Synthetic oligonucleotide
gaacacauccaccggcucu

SEQ ID NO: 845 - RNA, 19 nt, Artificial Sequence
  Description of Artificial Sequence: Synthetic oligonucleotide
aacacauccaccggcucuc

SEQ ID NO: 846 - RNA, 19 nt, Artificial Sequence
  Description of Artificial Sequence: Synthetic oligonucleotide
acacauccaccggcucucc

SEQ ID NO: 847 - RNA, 19 nt, Artificial Sequence
  Description of Artificial Sequence: Synthetic oligonucleotide
cacauccaccggcucucca

SEQ ID NO: 848 - RNA, 19 nt, Artificial Sequence
  Description of Artificial Sequence: Synthetic oligonucleotide
acauccaccggcucuccag

SEQ ID NO: 849 - RNA, 19 nt, Artificial Sequence
  Description of Artificial Sequence: Synthetic oligonucleotide
cauccaccggcucuccaga

SEQ ID NO: 850 - RNA, 19 nt, Artificial Sequence
  Description of Artificial Sequence: Synthetic oligonucleotide
auccaccggcucuccagac

SEQ ID NO: 851 - RNA, 19 nt, Artificial Sequence
  Description of Artificial Sequence: Synthetic oligonucleotide
uccaccggcucuccagaca

SEQ ID NO: 852 - RNA, 19 nt, Artificial Sequence
  Description of Artificial Sequence: Synthetic oligonucleotide
ccaccggcucuccagacag

SEQ ID NO: 853 - RNA, 19 nt, Artificial Sequence
  Description of Artificial Sequence: Synthetic oligonucleotide
caccggcucuccagacagc

SEQ ID NO: 854 - RNA, 19 nt, Artificial Sequence
  Description of Artificial Sequence: Synthetic oligonucleotide
accggcucuccagacagcc

SEQ ID NO: 855 - RNA, 19 nt, Artificial Sequence
  Description of Artificial Sequence: Synthetic oligonucleotide
ccggcucuccagacagcca

SEQ ID NO: 856 - RNA, 19 nt, Artificial Sequence
  Description of Artificial Sequence: Synthetic oligonucleotide
cggcucuccagacagccaa

SEQ ID NO: 857 - RNA, 19 nt, Artificial Sequence
  Description of Artificial Sequence: Synthetic oligonucleotide
ggcucuccagacagccaac

SEQ ID NO: 858 - RNA, 19 nt, Artificial Sequence
  Description of Artificial Sequence: Synthetic oligonucleotide
gcucuccagacagccaacc

SEQ ID NO: 859 - RNA, 19 nt, Artificial Sequence
  Description of Artificial Sequence: Synthetic oligonucleotide
cucuccagacagccaaccc

SEQ ID NO: 860 - RNA, 19 nt, Artificial Sequence
  Description of Artificial Sequence: Synthetic oligonucleotide
ucuccagacagccaacccg

SEQ ID NO: 861 - RNA, 19 nt, Artificial Sequence
  Description of Artificial Sequence: Synthetic oligonucleotide
cuccagacagccaacccgg

SEQ ID NO: 862 - RNA, 19 nt, Artificial Sequence
  Description of Artificial Sequence: Synthetic oligonucleotide
uccagacagccaacccggc

SEQ ID NO: 863 - RNA, 19 nt, Artificial Sequence
  Description of Artificial Sequence: Synthetic oligonucleotide
ccagacagccaacccggcu

SEQ ID NO: 864 - RNA, 19 nt, Artificial Sequence
  Description of Artificial Sequence: Synthetic oligonucleotide
cagacagccaacccggcug

SEQ ID NO: 865 - RNA, 19 nt, Artificial Sequence
  Description of Artificial Sequence: Synthetic oligonucleotide
agacagccaacccggcugc

SEQ ID NO: 866 - RNA, 19 nt, Artificial Sequence
  Description of Artificial Sequence: Synthetic oligonucleotide
gacagccaacccggcugcg

SEQ ID NO: 867 - RNA, 19 nt, Artificial Sequence
  Description of Artificial Sequence: Synthetic oligonucleotide
acagccaacccggcugcgu

SEQ ID NO: 868 - RNA, 19 nt, Artificial Sequence
  Description of Artificial Sequence: Synthetic oligonucleotide
cagccaacccggcugcgug

SEQ ID NO: 869 - RNA, 19 nt, Artificial Sequence
  Description of Artificial Sequence: Synthetic oligonucleotide
agccaacccggcugcgugu

SEQ ID NO: 870 - RNA, 19 nt, Artificial Sequence
  Description of Artificial Sequence: Synthetic oligonucleotide
gccaacccggcugcgugua

SEQ ID NO: 871 - RNA, 19 nt, Artificial Sequence
  Description of Artificial Sequence: Synthetic oligonucleotide
ccaacccggcugcguguag

SEQ ID NO: 872 - RNA, 19 nt, Artificial Sequence
  Description of Artificial Sequence: Synthetic oligonucleotide
caacccggcugcguguaga

SEQ ID NO: 873 - RNA, 19 nt, Artificial Sequence
  Description of Artificial Sequence: Synthetic oligonucleotide
aacccggcugcguguagag

SEQ ID NO: 874 - RNA, 19 nt, Artificial Sequence
  Description of Artificial Sequence: Synthetic oligonucleotide
acccggcugcguguagaga

SEQ ID NO: 875 - RNA, 19 nt, Artificial Sequence
  Description of Artificial Sequence: Synthetic oligonucleotide
cccggcugcguguagagau

SEQ ID NO: 876 - RNA, 19 nt, Artificial Sequence
  Description of Artificial Sequence: Synthetic oligonucleotide
ccggcugcguguagagaug

SEQ ID NO: 877 - RNA, 19 nt, Artificial Sequence
  Description of Artificial Sequence: Synthetic oligonucleotide
cggcugcguguagagaugg

SEQ ID NO: 878 - RNA, 19 nt, Artificial Sequence
  Description of Artificial Sequence: Synthetic oligonucleotide
ggcugcguguagagaugga

SEQ ID NO: 879 - RNA, 19 nt, Artificial Sequence
  Description of Artificial Sequence: Synthetic oligonucleotide
gcugcguguagagauggag

SEQ ID NO: 880 - RNA, 19 nt, Artificial Sequence
  Description of Artificial Sequence: Synthetic oligonucleotide
cugcguguagagauggagg

SEQ ID NO: 881 - RNA, 19 nt, Artificial Sequence
  Description of Artificial Sequence: Synthetic oligonucleotide
ugcguguagagauggagga

SEQ ID NO: 882 - RNA, 19 nt, Artificial Sequence
  Description of Artificial Sequence: Synthetic oligonucleotide
gcguguagagauggaggac

SEQ ID NO: 883 - RNA, 19 nt, Artificial Sequence
  Description of Artificial Sequence: Synthetic oligonucleotide
cguguagagauggaggacu

SEQ ID NO: 884 - RNA, 19 nt, Artificial Sequence
  Description of Artificial Sequence: Synthetic oligonucleotide
guguagagauggaggacug

SEQ ID NO: 885 - RNA, 19 nt, Artificial Sequence
  Description of Artificial Sequence: Synthetic oligonucleotide
uguagagauggaggacugg

SEQ ID NO: 886 - RNA, 19 nt, Artificial Sequence
  Description of Artificial Sequence: Synthetic oligonucleotide
guagagauggaggacuggg

SEQ ID NO: 887 - RNA, 19 nt, Artificial Sequence
  Description of Artificial Sequence: Synthetic oligonucleotide
uagagauggaggacuggga

SEQ ID NO: 888 - RNA, 19 nt, Artificial Sequence
  Description of Artificial Sequence: Synthetic oligonucleotide
agagauggaggacugggag

SEQ ID NO: 889 - RNA, 19 nt, Artificial Sequence
  Description of Artificial Sequence: Synthetic oligonucleotide
gagauggaggacugggagg

SEQ ID NO: 890 - RNA, 19 nt, Artificial Sequence
  Description of Artificial Sequence: Synthetic oligonucleotide
agauggaggacugggaggg

SEQ ID NO: 891 - RNA, 19 nt, Artificial Sequence
  Description of Artificial Sequence: Synthetic oligonucleotide
gauggaggacugggagggc

SEQ ID NO: 892 - RNA, 19 nt, Artificial Sequence
  Description of Artificial Sequence: Synthetic oligonucleotide
auggaggacugggagggca

SEQ ID NO: 893 - RNA, 19 nt, Artificial Sequence
  Description of Artificial Sequence: Synthetic oligonucleotide
uggaggacugggagggcaa

SEQ ID NO: 894 - RNA, 19 nt, Artificial Sequence
  Description of Artificial Sequence: Synthetic oligonucleotide
ggaggacugggagggcaac

SEQ ID NO: 895 - RNA, 19 nt, Artificial Sequence
  Description of Artificial Sequence: Synthetic oligonucleotide
gaggacugggagggcaacc

SEQ ID NO: 896 - RNA, 19 nt, Artificial Sequence
  Description of Artificial Sequence: Synthetic oligonucleotide
aggacugggagggcaaccu

SEQ ID NO: 897 - RNA, 19 nt, Artificial Sequence
  Description of Artificial Sequence: Synthetic oligonucleotide
ggacugggagggcaaccug

SEQ ID NO: 898 - RNA, 19 nt, Artificial Sequence
  Description of Artificial Sequence: Synthetic oligonucleotide
gacugggagggcaaccugc

SEQ ID NO: 899 - RNA, 19 nt, Artificial Sequence
  Description of Artificial Sequence: Synthetic oligonucleotide
acugggagggcaaccugcg

SEQ ID NO: 900 - RNA, 19 nt, Artificial Sequence
  Description of Artificial Sequence: Synthetic oligonucleotide
cugggagggcaaccugcgc

SEQ ID NO: 901 - RNA, 19 nt, Artificial Sequence
  Description of Artificial Sequence: Synthetic oligonucleotide
ugggagggcaaccugcgcu

SEQ ID NO: 902 - RNA, 19 nt, Artificial Sequence
  Description of Artificial Sequence: Synthetic oligonucleotide
gggagggcaaccugcgcua

SEQ ID NO: 903 - RNA, 19 nt, Artificial Sequence
  Description of Artificial Sequence: Synthetic oligonucleotide
ggagggcaaccugcgcuac

SEQ ID NO: 904 - RNA, 19 nt, Artificial Sequence
  Description of Artificial Sequence: Synthetic oligonucleotide
gagggcaaccugcgcuacg

SEQ ID NO: 905 - RNA, 19 nt, Artificial Sequence
  Description of Artificial Sequence: Synthetic oligonucleotide
agggcaaccugcgcuacgc

SEQ ID NO: 906 - RNA, 19 nt, Artificial Sequence
  Description of Artificial Sequence: Synthetic oligonucleotide
gggcaaccugcgcuacgcu

SEQ ID NO: 907 - RNA, 19 nt, Artificial Sequence
  Description of Artificial Sequence: Synthetic oligonucleotide
ggcaaccugcgcuacgcug

SEQ ID NO: 908 - RNA, 19 nt, Artificial Sequence
  Description of Artificial Sequence: Synthetic oligonucleotide
gcaaccugcgcuacgcuga

SEQ ID NO: 909 - RNA, 19 nt, Artificial Sequence
  Description of Artificial Sequence: Synthetic oligonucleotide
caaccugcgcuacgcugag

SEQ ID NO: 910 - RNA, 19 nt, Artificial Sequence
  Description of Artificial Sequence: Synthetic oligonucleotide
aaccugcgcuacgcugagu

SEQ ID NO: 911 - RNA, 19 nt, Artificial Sequence
  Description of Artificial Sequence: Synthetic oligonucleotide
accugcgcuacgcugagua

SEQ ID NO: 912 - RNA, 19 nt, Artificial Sequence
  Description of Artificial Sequence: Synthetic oligonucleotide
ccugcgcuacgcugaguau

SEQ ID NO: 913 - RNA, 19 nt, Artificial Sequence
  Description of Artificial Sequence: Synthetic oligonucleotide
cugcgcuacgcugaguaua

SEQ ID NO: 914 - RNA, 19 nt, Artificial Sequence
  Description of Artificial Sequence: Synthetic oligonucleotide
ugcgcuacgcugaguauag

SEQ ID NO: 915 - RNA, 19 nt, Artificial Sequence
  Description of Artificial Sequence: Synthetic oligonucleotide
gcgcuacgcugaguauagc

SEQ ID NO: 916 - RNA, 19 nt, Artificial Sequence
  Description of Artificial Sequence: Synthetic oligonucleotide
cgcuacgcugaguauagcc

SEQ ID NO: 917 - RNA, 19 nt, Artificial Sequence
  Description of Artificial Sequence: Synthetic oligonucleotide
gcuacgcugaguauagcca

SEQ ID NO: 918 - RNA, 19 nt, Artificial Sequence
  Description of Artificial Sequence: Synthetic oligonucleotide
cuacgcugaguauagccac

SEQ ID NO: 919 - RNA, 19 nt, Artificial Sequence
  Description of Artificial Sequence: Synthetic oligonucleotide
uacgcugaguauagccacu

SEQ ID NO: 920 - RNA, 19 nt, Artificial Sequence
  Description of Artificial Sequence: Synthetic oligonucleotide
acgcugaguauagccacuu

SEQ ID NO: 921 - RNA, 19 nt, Artificial Sequence
  Description of Artificial Sequence: Synthetic oligonucleotide
cgcugaguauagccacuuu

SEQ ID NO: 922 - RNA, 19 nt, Artificial Sequence
  Description of Artificial Sequence: Synthetic oligonucleotide
gcugaguauagccacuuug

SEQ ID NO: 923 - RNA, 19 nt, Artificial Sequence
  Description of Artificial Sequence: Synthetic oligonucleotide
cugaguauagccacuuugu

SEQ ID NO: 924 - RNA, 19 nt, Artificial Sequence
  Description of Artificial Sequence: Synthetic oligonucleotide
ugaguauagccacuuuguu

SEQ ID NO: 925 - RNA, 19 nt, Artificial Sequence
  Description of Artificial Sequence: Synthetic oligonucleotide
gaguauagccacuuuguuu

SEQ ID NO: 926 - RNA, 19 nt, Artificial Sequence
  Description of Artificial Sequence: Synthetic oligonucleotide
aguauagccacuuuguuuu

SEQ ID NO: 927 - RNA, 19 nt, Artificial Sequence
  Description of Artificial Sequence: Synthetic oligonucleotide
guauagccacuuuguuuug

SEQ ID NO: 928 - RNA, 19 nt, Artificial Sequence
  Description of Artificial Sequence: Synthetic oligonucleotide
uauagccacuuuguuuugg

SEQ ID NO: 929 - RNA, 19 nt, Artificial Sequence
  Description of Artificial Sequence: Synthetic oligonucleotide
auagccacuuuguuuuggg

SEQ ID NO: 930 - RNA, 19 nt, Artificial Sequence
  Description of Artificial Sequence: Synthetic oligonucleotide
uagccacuuuguuuugggc

SEQ ID NO: 931 - RNA, 19 nt, Artificial Sequence
  Description of Artificial Sequence: Synthetic oligonucleotide
agccacuuuguuuugggca

SEQ ID NO: 932 - RNA, 19 nt, Artificial Sequence
  Description of Artificial Sequence: Synthetic oligonucleotide
gccacuuuguuuugggcaa

SEQ ID NO: 933 - RNA, 19 nt, Artificial Sequence
  Description of Artificial Sequence: Synthetic oligonucleotide
ccacuuuguuuugggcaau

SEQ ID NO: 934 - RNA, 19 nt, Artificial Sequence
  Description of Artificial Sequence: Synthetic oligonucleotide
cacuuuguuuugggcaaug

SEQ ID NO: 935 - RNA, 19 nt, Artificial Sequence
  Description of Artificial Sequence: Synthetic oligonucleotide
acuuuguuuugggcaauga

SEQ ID NO: 936 - RNA, 19 nt, Artificial Sequence
  Description of Artificial Sequence: Synthetic oligonucleotide
cuuuguuuugggcaaugaa

SEQ ID NO: 937 - RNA, 19 nt, Artificial Sequence
  Description of Artificial Sequence: Synthetic oligonucleotide
uuuguuuugggcaaugaac

SEQ ID NO: 938 - RNA, 19 nt, Artificial Sequence
  Description of Artificial Sequence: Synthetic oligonucleotide
uuguuuugggcaaugaacu

SEQ ID NO: 939 - RNA, 19 nt, Artificial Sequence
  Description of Artificial Sequence: Synthetic oligonucleotide
uguuuugggcaaugaacuc

SEQ ID NO: 940 - RNA, 19 nt, Artificial Sequence
  Description of Artificial Sequence: Synthetic oligonucleotide
guuuugggcaaugaacuca

SEQ ID NO: 941 - RNA, 19 nt, Artificial Sequence
  Description of Artificial Sequence: Synthetic oligonucleotide
uuuugggcaaugaacucaa

SEQ ID NO: 942 - RNA, 19 nt, Artificial Sequence
  Description of Artificial Sequence: Synthetic oligonucleotide
uuugggcaaugaacucaac

SEQ ID NO: 943 - RNA, 19 nt, Artificial Sequence
  Description of Artificial Sequence: Synthetic oligonucleotide
uugggcaaugaacucaaca

SEQ ID NO: 944 - RNA, 19 nt, Artificial Sequence
  Description of Artificial Sequence: Synthetic oligonucleotide
ugggcaaugaacucaacag

SEQ ID NO: 945 - RNA, 19 nt, Artificial Sequence
  Description of Artificial Sequence: Synthetic oligonucleotide
gggcaaugaacucaacagc

SEQ ID NO: 946 - RNA, 19 nt, Artificial Sequence
  Description of Artificial Sequence: Synthetic oligonucleotide
ggcaaugaacucaacagcu

SEQ ID NO: 947 - RNA, 19 nt, Artificial Sequence
  Description of Artificial Sequence: Synthetic oligonucleotide
gcaaugaacucaacagcua

SEQ ID NO: 948 - RNA, 19 nt, Artificial Sequence
  Description of Artificial Sequence: Synthetic oligonucleotide
caaugaacucaacagcuau

SEQ ID NO: 949 - RNA, 19 nt, Artificial Sequence
  Description of Artificial Sequence: Synthetic oligonucleotide
aaugaacucaacagcuauc

SEQ ID NO: 950 - RNA, 19 nt, Artificial Sequence
  Description of Artificial Sequence: Synthetic oligonucleotide
augaacucaacagcuaucg

SEQ ID NO: 951 - RNA, 19 nt, Artificial Sequence
  Description of Artificial Sequence: Synthetic oligonucleotide
ugaacucaacagcuaucgc

SEQ ID NO: 952 - RNA, 19 nt, Artificial Sequence
  Description of Artificial Sequence: Synthetic oligonucleotide
gaacucaacagcuaucgcc

SEQ ID NO: 953 - RNA, 19 nt, Artificial Sequence
  Description of Artificial Sequence: Synthetic oligonucleotide
aacucaacagcuaucgccu

SEQ ID NO: 954 - RNA, 19 nt, Artificial Sequence
  Description of Artificial Sequence: Synthetic oligonucleotide
acucaacagcuaucgccuc

SEQ ID NO: 955 - RNA, 19 nt, Artificial Sequence
  Description of Artificial Sequence: Synthetic oligonucleotide
cucaacagcuaucgccucu

SEQ ID NO: 956 - RNA, 19 nt, Artificial Sequence
  Description of Artificial Sequence: Synthetic oligonucleotide
ucaacagcuaucgccucuu

SEQ ID NO: 957 - RNA, 19 nt, Artificial Sequence
  Description of Artificial Sequence: Synthetic oligonucleotide
caacagcuaucgccucuuc

SEQ ID NO: 958 - RNA, 19 nt, Artificial Sequence
  Description of Artificial Sequence: Synthetic oligonucleotide
aacagcuaucgccucuucc

SEQ ID NO: 959 - RNA, 19 nt, Artificial Sequence
  Description of Artificial Sequence: Synthetic oligonucleotide
acagcuaucgccucuuccu

SEQ ID NO: 960 - RNA, 19 nt, Artificial Sequence
  Description of Artificial Sequence: Synthetic oligonucleotide
cagcuaucgccucuuccug

SEQ ID NO: 961 - RNA, 19 nt, Artificial Sequence
  Description of Artificial Sequence: Synthetic oligonucleotide
agcuaucgccucuuccugg

SEQ ID NO: 962 - RNA, 19 nt, Artificial Sequence
  Description of Artificial Sequence: Synthetic oligonucleotide
gcuaucgccucuuccuggg

SEQ ID NO: 963 - RNA, 19 nt, Artificial Sequence
  Description of Artificial Sequence: Synthetic oligonucleotide
cuaucgccucuuccugggg

SEQ ID NO: 964 - RNA, 19 nt, Artificial Sequence
  Description of Artificial Sequence: Synthetic oligonucleotide
uaucgccucuuccugggga

SEQ ID NO: 965 - RNA, 19 nt, Artificial Sequence
  Description of Artificial Sequence: Synthetic oligonucleotide
aucgccucuuccuggggaa

SEQ ID NO: 966 - RNA, 19 nt, Artificial Sequence
  Description of Artificial Sequence: Synthetic oligonucleotide
ucgccucuuccuggggaac

SEQ ID NO: 967 - RNA, 19 nt, Artificial Sequence
  Description of Artificial Sequence: Synthetic oligonucleotide
cgccucuuccuggggaacu

SEQ ID NO: 968 - RNA, 19 nt, Artificial Sequence
  Description of Artificial Sequence: Synthetic oligonucleotide
gccucuuccuggggaacua

SEQ ID NO: 969 - RNA, 19 nt, Artificial Sequence
  Description of Artificial Sequence: Synthetic oligonucleotide
ccucuuccuggggaacuac

SEQ ID NO: 970 - RNA, 19 nt, Artificial Sequence
  Description of Artificial Sequence: Synthetic oligonucleotide
cucuuccuggggaacuaca

SEQ ID NO: 971 - RNA, 19 nt, Artificial Sequence
  Description of Artificial Sequence: Synthetic oligonucleotide
ucuuccuggggaacuacac

SEQ ID NO: 972 - RNA, 19 nt, Artificial Sequence
  Description of Artificial Sequence: Synthetic oligonucleotide
cuuccuggggaacuacacu

SEQ ID NO: 973 - RNA, 19 nt, Artificial Sequence
  Description of Artificial Sequence: Synthetic oligonucleotide
uuccuggggaacuacacug

SEQ ID NO: 974 - RNA, 19 nt, Artificial Sequence
  Description of Artificial Sequence: Synthetic oligonucleotide
uccuggggaacuacacugg

SEQ ID NO: 975 - RNA, 19 nt, Artificial Sequence
  Description of Artificial Sequence: Synthetic oligonucleotide
ccuggggaacuacacuggc

SEQ ID NO: 976 - RNA, 19 nt, Artificial Sequence
  Description of Artificial Sequence: Synthetic oligonucleotide
cuggggaacuacacuggca

SEQ ID NO: 977 - RNA, 19 nt, Artificial Sequence
  Description of Artificial Sequence: Synthetic oligonucleotide
uggggaacuacacuggcaa

SEQ ID NO: 978 - RNA, 19 nt, Artificial Sequence
  Description of Artificial Sequence: Synthetic oligonucleotide
ggggaacuacacuggcaau

SEQ ID NO: 979 - RNA, 19 nt, Artificial Sequence
  Description of Artificial Sequence: Synthetic oligonucleotide
gggaacuacacuggcaaug

SEQ ID NO: 980 - RNA, 19 nt, Artificial Sequence
  Description of Artificial Sequence: Synthetic oligonucleotide
ggaacuacacuggcaaugu

SEQ ID NO: 981 - RNA, 19 nt, Artificial Sequence
  Description of Artificial Sequence: Synthetic oligonucleotide
gaacuacacuggcaaugug

SEQ ID NO: 982 - RNA, 19 nt, Artificial Sequence
  Description of Artificial Sequence: Synthetic oligonucleotide
aacuacacuggcaaugugg

SEQ ID NO: 983 - RNA, 19 nt, Artificial Sequence
  Description of Artificial Sequence: Synthetic oligonucleotide
acuacacuggcaauguggg

SEQ ID NO: 984 - RNA, 19 nt, Artificial Sequence
  Description of Artificial Sequence: Synthetic oligonucleotide
cuacacuggcaaugugggg

SEQ ID NO: 985 - RNA, 19 nt, Artificial Sequence
  Description of Artificial Sequence: Synthetic oligonucleotide
uacacuggcaaugugggga

SEQ ID NO: 986 - RNA, 19 nt, Artificial Sequence
  Description of Artificial Sequence: Synthetic oligonucleotide
acacuggcaauguggggaa

SEQ ID NO: 987 - RNA, 19 nt, Artificial Sequence
  Description of Artificial Sequence: Synthetic oligonucleotide
cacuggcaauguggggaac

SEQ ID NO: 988 - RNA, 19 nt, Artificial Sequence
  Description of Artificial Sequence: Synthetic oligonucleotide
acuggcaauguggggaacg

SEQ ID NO: 989 - RNA, 19 nt, Artificial Sequence
  Description of Artificial Sequence: Synthetic oligonucleotide
cuggcaauguggggaacga

SEQ ID NO: 990 - RNA, 19 nt, Artificial Sequence
  Description of Artificial Sequence: Synthetic oligonucleotide
uggcaauguggggaacgac

SEQ ID NO: 991 - RNA, 19 nt, Artificial Sequence
  Description of Artificial Sequence: Synthetic oligonucleotide
ggcaauguggggaacgacg

SEQ ID NO: 992 - RNA, 19 nt, Artificial Sequence
  Description of Artificial Sequence: Synthetic oligonucleotide
gcaauguggggaacgacgc

SEQ ID NO: 993 - RNA, 19 nt, Artificial Sequence
  Description of Artificial Sequence: Synthetic oligonucleotide
caauguggggaacgacgcc

SEQ ID NO: 994 - RNA, 19 nt, Artificial Sequence
  Description of Artificial Sequence: Synthetic oligonucleotide
aauguggggaacgacgccc

SEQ ID NO: 995 - RNA, 19 nt, Artificial Sequence
  Description of Artificial Sequence: Synthetic oligonucleotide
auguggggaacgacgcccu

SEQ ID NO: 996 - RNA, 19 nt, Artificial Sequence
  Description of Artificial Sequence: Synthetic oligonucleotide
uguggggaacgacgcccuc

SEQ ID NO: 997 - RNA, 19 nt, Artificial Sequence
  Description of Artificial Sequence: Synthetic oligonucleotide
guggggaacgacgcccucc

SEQ ID NO: 998 - RNA, 19 nt, Artificial Sequence
  Description of Artificial Sequence: Synthetic oligonucleotide
uggggaacgacgcccucca

SEQ ID NO: 999 - RNA, 19 nt, Artificial Sequence
  Description of Artificial Sequence: Synthetic oligonucleotide
ggggaacgacgcccuccag

SEQ ID NO: 1000 - RNA, 19 nt, Artificial Sequence
  Description of Artificial Sequence: Synthetic oligonucleotide
gggaacgacgcccuccagu

SEQ ID NO: 1001 - RNA, 19 nt, Artificial Sequence
  Description of Artificial Sequence: Synthetic oligonucleotide
ggaacgacgcccuccagua

SEQ ID NO: 1002 - RNA, 19 nt, Artificial Sequence
  Description of Artificial Sequence: Synthetic oligonucleotide
gaacgacgcccuccaguau

SEQ ID NO: 1003 - RNA, 19 nt, Artificial Sequence
  Description of Artificial Sequence: Synthetic oligonucleotide
aacgacgcccuccaguauc

SEQ ID NO: 1004 - RNA, 19 nt, Artificial Sequence
  Description of Artificial Sequence: Synthetic oligonucleotide
acgacgcccuccaguauca

SEQ ID NO: 1005 - RNA, 19 nt, Artificial Sequence
  Description of Artificial Sequence: Synthetic oligonucleotide
cgacgcccuccaguaucau

SEQ ID NO: 1006 - RNA, 19 nt, Artificial Sequence
  Description of Artificial Sequence: Synthetic oligonucleotide
gacgcccuccaguaucaua

SEQ ID NO: 1007 - RNA, 19 nt, Artificial Sequence
  Description of Artificial Sequence: Synthetic oligonucleotide
acgcccuccaguaucauaa

SEQ ID NO: 1008 - RNA, 19 nt, Artificial Sequence
  Description of Artificial Sequence: Synthetic oligonucleotide
cgcccuccaguaucauaac

SEQ ID NO: 1009 - RNA, 19 nt, Artificial Sequence
  Description of Artificial Sequence: Synthetic oligonucleotide
gcccuccaguaucauaaca

SEQ ID NO: 1010 - RNA, 19 nt, Artificial Sequence
  Description of Artificial Sequence: Synthetic oligonucleotide
cccuccaguaucauaacaa

SEQ ID NO: 1011 - RNA, 19 nt, Artificial Sequence
  Description of Artificial Sequence: Synthetic oligonucleotide
ccuccaguaucauaacaac

SEQ ID NO: 1012 - RNA, 19 nt, Artificial Sequence
  Description of Artificial Sequence: Synthetic oligonucleotide
cuccaguaucauaacaaca

SEQ ID NO: 1013 - RNA, 19 nt, Artificial Sequence
  Description of Artificial Sequence: Synthetic oligonucleotide
uccaguaucauaacaacac

SEQ ID NO: 1014 - RNA, 19 nt, Artificial Sequence
  Description of Artificial Sequence: Synthetic oligonucleotide
ccaguaucauaacaacaca

SEQ ID NO: 1015 - RNA, 19 nt, Artificial Sequence
  Description of Artificial Sequence: Synthetic oligonucleotide
caguaucauaacaacacag

SEQ ID NO: 1016 - RNA, 19 nt, Artificial Sequence
  Description of Artificial Sequence: Synthetic oligonucleotide
aguaucauaacaacacagc

SEQ ID NO: 1017 - RNA, 19 nt, Artificial Sequence
  Description of Artificial Sequence: Synthetic oligonucleotide
guaucauaacaacacagcc

SEQ ID NO: 1018 - RNA, 19 nt, Artificial Sequence
  Description of Artificial Sequence: Synthetic oligonucleotide
uaucauaacaacacagccu

SEQ ID NO: 1019 - RNA, 19 nt, Artificial Sequence
  Description of Artificial Sequence: Synthetic oligonucleotide
aucauaacaacacagccuu

SEQ ID NO: 1020 - RNA, 19 nt, Artificial Sequence
  Description of Artificial Sequence: Synthetic oligonucleotide
ucauaacaacacagccuuc

SEQ ID NO: 1021 - RNA, 19 nt, Artificial Sequence
  Description of Artificial Sequence: Synthetic oligonucleotide
cauaacaacacagccuuca

SEQ ID NO: 1022 - RNA, 19 nt, Artificial Sequence
  Description of Artificial Sequence: Synthetic oligonucleotide
auaacaacacagccuucag

SEQ ID NO: 1023 - RNA, 19 nt, Artificial Sequence
  Description of Artificial Sequence: Synthetic oligonucleotide
uaacaacacagccuucagc

SEQ ID NO: 1024 - RNA, 19 nt, Artificial Sequence
  Description of Artificial Sequence: Synthetic oligonucleotide
aacaacacagccuucagca

SEQ ID NO: 1025 - RNA, 19 nt, Artificial Sequence
  Description of Artificial Sequence: Synthetic oligonucleotide
acaacacagccuucagcac

SEQ ID NO: 1026 - RNA, 19 nt, Artificial Sequence
  Description of Artificial Sequence: Synthetic oligonucleotide
caacacagccuucagcacc

SEQ ID NO: 1027 - RNA, 19 nt, Artificial Sequence
  Description of Artificial Sequence: Synthetic oligonucleotide
aacacagccuucagcacca

SEQ ID NO: 1028 - RNA, 19 nt, Artificial Sequence
  Description of Artificial Sequence: Synthetic oligonucleotide
acacagccuucagcaccaa

SEQ ID NO: 1029 - RNA, 19 nt, Artificial Sequence
  Description of Artificial Sequence: Synthetic oligonucleotide
cacagccuucagcaccaag

SEQ ID NO: 1030 - RNA, 19 nt, Artificial Sequence
  Description of Artificial Sequence: Synthetic oligonucleotide
acagccuucagcaccaagg

SEQ ID NO: 1031 - RNA, 19 nt, Artificial Sequence
  Description of Artificial Sequence: Synthetic oligonucleotide
cagccuucagcaccaagga

SEQ ID NO: 1032 - RNA, 19 nt, Artificial Sequence
  Description of Artificial Sequence: Synthetic oligonucleotide
agccuucagcaccaaggac

SEQ ID NO: 1033 - RNA, 19 nt, Artificial Sequence
  Description of Artificial Sequence: Synthetic oligonucleotide
gccuucagcaccaaggaca

SEQ ID NO: 1034 - RNA, 19 nt, Artificial Sequence
  Description of Artificial Sequence: Synthetic oligonucleotide
ccuucagcaccaaggacaa

SEQ ID NO: 1035 - RNA, 19 nt, Artificial Sequence
  Description of Artificial Sequence: Synthetic oligonucleotide
cuucagcaccaaggacaag

SEQ ID NO: 1036 - RNA, 19 nt, Artificial Sequence
  Description of Artificial Sequence: Synthetic oligonucleotide
uucagcaccaaggacaagg

SEQ ID NO: 1037 - RNA, 19 nt, Artificial Sequence
  Description of Artificial Sequence: Synthetic oligonucleotide
ucagcaccaaggacaagga

SEQ ID NO: 1038 - RNA, 19 nt, Artificial Sequence
  Description of Artificial Sequence: Synthetic oligonucleotide
cagcaccaaggacaaggac

SEQ ID NO: 1039 - RNA, 19 nt, Artificial Sequence
  Description of Artificial Sequence: Synthetic oligonucleotide
agcaccaaggacaaggaca

SEQ ID NO: 1040 - RNA, 19 nt, Artificial Sequence
  Description of Artificial Sequence: Synthetic oligonucleotide
gcaccaaggacaaggacaa

SEQ ID NO: 1041 - RNA, 19 nt, Artificial Sequence
  Description of Artificial Sequence: Synthetic oligonucleotide
caccaaggacaaggacaau

SEQ ID NO: 1042 - RNA, 19 nt, Artificial Sequence
  Description of Artificial Sequence: Synthetic oligonucleotide
accaaggacaaggacaaug

SEQ ID NO: 1043 - RNA, 19 nt, Artificial Sequence
  Description of Artificial Sequence: Synthetic oligonucleotide
ccaaggacaaggacaauga

SEQ ID NO: 1044 - RNA, 19 nt, Artificial Sequence
  Description of Artificial Sequence: Synthetic oligonucleotide
caaggacaaggacaaugac

SEQ ID NO: 1045 - RNA, 19 nt, Artificial Sequence
  Description of Artificial Sequence: Synthetic oligonucleotide
aaggacaaggacaaugaca

SEQ ID NO: 1046 - RNA, 19 nt, Artificial Sequence
  Description of Artificial Sequence: Synthetic oligonucleotide
aggacaaggacaaugacaa

SEQ ID NO: 1047 - RNA, 19 nt, Artificial Sequence
  Description of Artificial Sequence: Synthetic oligonucleotide
ggacaaggacaaugacaac

SEQ ID NO: 1048 - RNA, 19 nt, Artificial Sequence
  Description of Artificial Sequence: Synthetic oligonucleotide
gacaaggacaaugacaacu

SEQ ID NO: 1049 - RNA, 19 nt, Artificial Sequence
  Description of Artificial Sequence: Synthetic oligonucleotide
acaaggacaaugacaacug

SEQ ID NO: 1050 - RNA, 19 nt, Artificial Sequence
  Description of Artificial Sequence: Synthetic oligonucleotide
caaggacaaugacaacugc

SEQ ID NO: 1051 - RNA, 19 nt, Artificial Sequence
  Description of Artificial Sequence: Synthetic oligonucleotide
aaggacaaugacaacugcu

SEQ ID NO: 1052 - RNA, 19 nt, Artificial Sequence
  Description of Artificial Sequence: Synthetic oligonucleotide
aggacaaugacaacugcuu

SEQ ID NO: 1053 - RNA, 19 nt, Artificial Sequence
  Description of Artificial Sequence: Synthetic oligonucleotide
ggacaaugacaacugcuug

SEQ ID NO: 1054 - RNA, 19 nt, Artificial Sequence
  Description of Artificial Sequence: Synthetic oligonucleotide
gacaaugacaacugcuugg

SEQ ID NO: 1055 - RNA, 19 nt, Artificial Sequence
  Description of Artificial Sequence: Synthetic oligonucleotide
acaaugacaacugcuugga

SEQ ID NO: 1056 - RNA, 19 nt, Artificial Sequence
  Description of Artificial Sequence: Synthetic oligonucleotide
caaugacaacugcuuggac

SEQ ID NO: 1057 - RNA, 19 nt, Artificial Sequence
  Description of Artificial Sequence: Synthetic oligonucleotide
aaugacaacugcuuggaca

SEQ ID NO: 1058 - RNA, 19 nt, Artificial Sequence
  Description of Artificial Sequence: Synthetic oligonucleotide
augacaacugcuuggacaa

SEQ ID NO: 1059 - RNA, 19 nt, Artificial Sequence
  Description of Artificial Sequence: Synthetic oligonucleotide
ugacaacugcuuggacaag

SEQ ID NO: 1060 - RNA, 19 nt, Artificial Sequence
  Description of Artificial Sequence: Synthetic oligonucleotide
gacaacugcuuggacaagu

SEQ ID NO: 1061 - RNA, 19 nt, Artificial Sequence
  Description of Artificial Sequence: Synthetic oligonucleotide
acaacugcuuggacaagug

SEQ ID NO: 1062 - RNA, 19 nt, Artificial Sequence
  Description of Artificial Sequence: Synthetic oligonucleotide
caacugcuuggacaagugu

SEQ ID NO: 1063 - RNA, 19 nt, Artificial Sequence
  Description of Artificial Sequence: Synthetic oligonucleotide
aacugcuuggacaagugug

SEQ ID NO: 1064 - RNA, 19 nt, Artificial Sequence
  Description of Artificial Sequence: Synthetic oligonucleotide
acugcuuggacaagugugc

SEQ ID NO: 1065 - RNA, 19 nt, Artificial Sequence
  Description of Artificial Sequence: Synthetic oligonucleotide
cugcuuggacaagugugca

SEQ ID NO: 1066 - RNA, 19 nt, Artificial Sequence
  Description of Artificial Sequence: Synthetic oligonucleotide
ugcuuggacaagugugcac

SEQ ID NO: 1067 - RNA, 19 nt, Artificial Sequence
  Description of Artificial Sequence: Synthetic oligonucleotide
gcuuggacaagugugcaca

SEQ ID NO: 1068 - RNA, 19 nt, Artificial Sequence
  Description of Artificial Sequence: Synthetic oligonucleotide
cuuggacaagugugcacag

SEQ ID NO: 1069 - RNA, 19 nt, Artificial Sequence
  Description of Artificial Sequence: Synthetic oligonucleotide
uuggacaagugugcacagc

SEQ ID NO: 1070 - RNA, 19 nt, Artificial Sequence
  Description of Artificial Sequence: Synthetic oligonucleotide
uggacaagugugcacagcu

SEQ ID NO: 1071 - RNA, 19 nt, Artificial Sequence
  Description of Artificial Sequence: Synthetic oligonucleotide
ggacaagugugcacagcuc

SEQ ID NO: 1072 - RNA, 19 nt, Artificial Sequence
  Description of Artificial Sequence: Synthetic oligonucleotide
gacaagugugcacagcucc

SEQ ID NO: 1073 - RNA, 19 nt, Artificial Sequence
  Description of Artificial Sequence: Synthetic oligonucleotide
acaagugugcacagcuccg

SEQ ID NO: 1074 - RNA, 19 nt, Artificial Sequence
  Description of Artificial Sequence: Synthetic oligonucleotide
caagugugcacagcuccgc

SEQ ID NO: 1075 - RNA, 19 nt, Artificial Sequence
  Description of Artificial Sequence: Synthetic oligonucleotide
aagugugcacagcuccgca

SEQ ID NO: 1076 - RNA, 19 nt, Artificial Sequence
  Description of Artificial Sequence: Synthetic oligonucleotide
agugugcacagcuccgcaa

SEQ ID NO: 1077 - RNA, 19 nt, Artificial Sequence
  Description of Artificial Sequence: Synthetic oligonucleotide
gugugcacagcuccgcaaa

SEQ ID NO: 1078 - RNA, 19 nt, Artificial Sequence
  Description of Artificial Sequence: Synthetic oligonucleotide
ugugcacagcuccgcaaag

SEQ ID NO: 1079 - RNA, 19 nt, Artificial Sequence
  Description of Artificial Sequence: Synthetic oligonucleotide
gugcacagcuccgcaaagg

SEQ ID NO: 1080 - RNA, 19 nt, Artificial Sequence
  Description of Artificial Sequence: Synthetic oligonucleotide
ugcacagcuccgcaaaggu

SEQ ID NO: 1081 - RNA, 19 nt, Artificial Sequence
  Description of Artificial Sequence: Synthetic oligonucleotide
gcacagcuccgcaaaggug

SEQ ID NO: 1082 - RNA, 19 nt, Artificial Sequence
  Description of Artificial Sequence: Synthetic oligonucleotide
cacagcuccgcaaaggugg

SEQ ID NO: 1083 - RNA, 19 nt, Artificial Sequence
  Description of Artificial Sequence: Synthetic oligonucleotide
acagcuccgcaaagguggc

SEQ ID NO: 1084 - RNA, 19 nt, Artificial Sequence
  Description of Artificial Sequence: Synthetic oligonucleotide
cagcuccgcaaagguggcu

SEQ ID NO: 1085 - RNA, 19 nt, Artificial Sequence
  Description of Artificial Sequence: Synthetic oligonucleotide
agcuccgcaaagguggcua

SEQ ID NO: 1086 - RNA, 19 nt, Artificial Sequence
  Description of Artificial Sequence: Synthetic oligonucleotide
gcuccgcaaagguggcuac

SEQ ID NO: 1087 - RNA, 19 nt, Artificial Sequence
  Description of Artificial Sequence: Synthetic oligonucleotide
cuccgcaaagguggcuacu

SEQ ID NO: 1088 - RNA, 19 nt, Artificial Sequence
  Description of Artificial Sequence: Synthetic oligonucleotide
uccgcaaagguggcuacug

SEQ ID NO: 1089 - RNA, 19 nt, Artificial Sequence
  Description of Artificial Sequence: Synthetic oligonucleotide
ccgcaaagguggcuacugg

SEQ ID NO: 1090 - RNA, 19 nt, Artificial Sequence
  Description of Artificial Sequence: Synthetic oligonucleotide
cgcaaagguggcuacuggu

SEQ ID NO: 1091 - RNA, 19 nt, Artificial Sequence
  Description of Artificial Sequence: Synthetic oligonucleotide
gcaaagguggcuacuggua

SEQ ID NO: 1092 - RNA, 19 nt, Artificial Sequence
  Description of Artificial Sequence: Synthetic oligonucleotide
caaagguggcuacugguac

SEQ ID NO: 1093 - RNA, 19 nt, Artificial Sequence
  Description of Artificial Sequence: Synthetic oligonucleotide
aaagguggcuacugguaca

SEQ ID NO: 1094 - RNA, 19 nt, Artificial Sequence
  Description of Artificial Sequence: Synthetic oligonucleotide
aagguggcuacugguacaa

SEQ ID NO: 1095 - RNA, 19 nt, Artificial Sequence
  Description of Artificial Sequence: Synthetic oligonucleotide
agguggcuacugguacaac

SEQ ID NO: 1096 - RNA, 19 nt, Artificial Sequence
  Description of Artificial Sequence: Synthetic oligonucleotide
gguggcuacugguacaacu

SEQ ID NO: 1097 - RNA, 19 nt, Artificial Sequence
  Description of Artificial Sequence: Synthetic oligonucleotide
guggcuacugguacaacug

SEQ ID NO: 1098 - RNA, 19 nt, Artificial Sequence
  Description of Artificial Sequence: Synthetic oligonucleotide
uggcuacugguacaacugc

SEQ ID NO: 1099 - RNA, 19 nt, Artificial Sequence
  Description of Artificial Sequence: Synthetic oligonucleotide
ggcuacugguacaacugcu

SEQ ID NO: 1100 - RNA, 19 nt, Artificial Sequence
  Description of Artificial Sequence: Synthetic oligonucleotide
gcuacugguacaacugcug

SEQ ID NO: 1101 - RNA, 19 nt, Artificial Sequence
  Description of Artificial Sequence: Synthetic oligonucleotide
cuacugguacaacugcugc

SEQ ID NO: 1102 - RNA, 19 nt, Artificial Sequence
  Description of Artificial Sequence: Synthetic oligonucleotide
uacugguacaacugcugca

SEQ ID NO: 1103 - RNA, 19 nt, Artificial Sequence
  Description of Artificial Sequence: Synthetic oligonucleotide
acugguacaacugcugcac

SEQ ID NO: 1104 - RNA, 19 nt, Artificial Sequence
  Description of Artificial Sequence: Synthetic oligonucleotide
cugguacaacugcugcaca

SEQ ID NO: 1105 - RNA, 19 nt, Artificial Sequence
  Description of Artificial Sequence: Synthetic oligonucleotide
ugguacaacugcugcacag

SEQ ID NO: 1106 - RNA, 19 nt, Artificial Sequence
  Description of Artificial Sequence: Synthetic oligonucleotide
gguacaacugcugcacaga

SEQ ID NO: 1107 - RNA, 19 nt, Artificial Sequence
  Description of Artificial Sequence: Synthetic oligonucleotide
guacaacugcugcacagac

SEQ ID NO: 1108 - RNA, 19 nt, Artificial Sequence
  Description of Artificial Sequence: Synthetic oligonucleotide
uacaacugcugcacagacu

SEQ ID NO: 1109 - RNA, 19 nt, Artificial Sequence
  Description of Artificial Sequence: Synthetic oligonucleotide
acaacugcugcacagacuc

SEQ ID NO: 1110 - RNA, 19 nt, Artificial Sequence
  Description of Artificial Sequence: Synthetic oligonucleotide
caacugcugcacagacucc

SEQ ID NO: 1111 - RNA, 19 nt, Artificial Sequence
  Description of Artificial Sequence: Synthetic oligonucleotide
aacugcugcacagacucca

SEQ ID NO: 1112 - RNA, 19 nt, Artificial Sequence
  Description of Artificial Sequence: Synthetic oligonucleotide
acugcugcacagacuccaa

SEQ ID NO: 1113 - RNA, 19 nt, Artificial Sequence
  Description of Artificial Sequence: Synthetic oligonucleotide
cugcugcacagacuccaac

SEQ ID NO: 1114 - RNA, 19 nt, Artificial Sequence
  Description of Artificial Sequence: Synthetic oligonucleotide
ugcugcacagacuccaacc

SEQ ID NO: 1115 - RNA, 19 nt, Artificial Sequence
  Description of Artificial Sequence: Synthetic oligonucleotide
gcugcacagacuccaaccu

SEQ ID NO: 1116 - RNA, 19 nt, Artificial Sequence
  Description of Artificial Sequence: Synthetic oligonucleotide
cugcacagacuccaaccuc

SEQ ID NO: 1117 - RNA, 19 nt, Artificial Sequence
  Description of Artificial Sequence: Synthetic oligonucleotide
ugcacagacuccaaccuca

SEQ ID NO: 1118 - RNA, 19 nt, Artificial Sequence
  Description of Artificial Sequence: Synthetic oligonucleotide
gcacagacuccaaccucaa

SEQ ID NO: 1119 - RNA, 19 nt, Artificial Sequence
  Description of Artificial Sequence: Synthetic oligonucleotide
cacagacuccaaccucaau

SEQ ID NO: 1120 - RNA, 19 nt, Artificial Sequence
  Description of Artificial Sequence: Synthetic oligonucleotide
acagacuccaaccucaaug

SEQ ID NO: 1121 - RNA, 19 nt, Artificial Sequence
  Description of Artificial Sequence: Synthetic oligonucleotide
cagacuccaaccucaaugg

SEQ ID NO: 1122 - RNA, 19 nt, Artificial Sequence
  Description of Artificial Sequence: Synthetic oligonucleotide
agacuccaaccucaaugga

SEQ ID NO: 1123 - RNA, 19 nt, Artificial Sequence
  Description of Artificial Sequence: Synthetic oligonucleotide
gacuccaaccucaauggag

SEQ ID NO: 1124 - RNA, 19 nt, Artificial Sequence
  Description of Artificial Sequence: Synthetic oligonucleotide
acuccaaccucaauggagu

SEQ ID NO: 1125 - RNA, 19 nt, Artificial Sequence
  Description of Artificial Sequence: Synthetic oligonucleotide
cuccaaccucaauggagug

SEQ ID NO: 1126 - RNA, 19 nt, Artificial Sequence
  Description of Artificial Sequence: Synthetic oligonucleotide
uccaaccucaauggagugu

SEQ ID NO: 1127 - RNA, 19 nt, Artificial Sequence
  Description of Artificial Sequence: Synthetic oligonucleotide
ccaaccucaauggagugua

SEQ ID NO: 1128 - RNA, 19 nt, Artificial Sequence
  Description of Artificial Sequence: Synthetic oligonucleotide
caaccucaauggaguguac

SEQ ID NO: 1129 - RNA, 19 nt, Artificial Sequence
  Description of Artificial Sequence: Synthetic oligonucleotide
aaccucaauggaguguacu

SEQ ID NO: 1130 - RNA, 19 nt, Artificial Sequence
  Description of Artificial Sequence: Synthetic oligonucleotide
accucaauggaguguacua

SEQ ID NO: 1131 - RNA, 19 nt, Artificial Sequence
  Description of Artificial Sequence: Synthetic oligonucleotide
ccucaauggaguguacuac

SEQ ID NO: 1132 - RNA, 19 nt, Artificial Sequence
  Description of Artificial Sequence: Synthetic oligonucleotide
cucaauggaguguacuacc

SEQ ID NO: 1133 - RNA, 19 nt, Artificial Sequence
  Description of Artificial Sequence: Synthetic oligonucleotide
ucaauggaguguacuaccg

SEQ ID NO: 1134 - RNA, 19 nt, Artificial Sequence
  Description of Artificial Sequence: Synthetic oligonucleotide
caauggaguguacuaccgc

SEQ ID NO: 1135 - RNA, 19 nt, Artificial Sequence
  Description of Artificial Sequence: Synthetic oligonucleotide
aauggaguguacuaccgcc

SEQ ID NO: 1136 - RNA, 19 nt, Artificial Sequence
  Description of Artificial Sequence: Synthetic oligonucleotide
auggaguguacuaccgccu

SEQ ID NO: 1137 - RNA, 19 nt, Artificial Sequence
  Description of Artificial Sequence: Synthetic oligonucleotide
uggaguguacuaccgccug

SEQ ID NO: 1138 - RNA, 19 nt, Artificial Sequence
  Description of Artificial Sequence: Synthetic oligonucleotide
ggaguguacuaccgccugg

SEQ ID NO: 1139 - RNA, 19 nt, Artificial Sequence
  Description of Artificial Sequence: Synthetic oligonucleotide
gaguguacuaccgccuggg

SEQ ID NO: 1140 - RNA, 19 nt, Artificial Sequence
  Description of Artificial Sequence: Synthetic oligonucleotide
aguguacuaccgccugggu

SEQ ID NO: 1141 - RNA, 19 nt, Artificial Sequence
  Description of Artificial Sequence: Synthetic oligonucleotide
guguacuaccgccugggug

SEQ ID NO: 1142 - RNA, 19 nt, Artificial Sequence
  Description of Artificial Sequence: Synthetic oligonucleotide
uguacuaccgccuggguga

SEQ ID NO: 1143 - RNA, 19 nt, Artificial Sequence
  Description of Artificial Sequence: Synthetic oligonucleotide
guacuaccgccugggugag

SEQ ID NO: 1144 - RNA, 19 nt, Artificial Sequence
  Description of Artificial Sequence: Synthetic oligonucleotide
uacuaccgccugggugagc

SEQ ID NO: 1145 - RNA, 19 nt, Artificial Sequence
  Description of Artificial Sequence: Synthetic oligonucleotide
acuaccgccugggugagca

SEQ ID NO: 1146 - RNA, 19 nt, Artificial Sequence
  Description of Artificial Sequence: Synthetic oligonucleotide
cuaccgccugggugagcac

SEQ ID NO: 1147 - RNA, 19 nt, Artificial Sequence
  Description of Artificial Sequence: Synthetic oligonucleotide
uaccgccugggugagcaca

SEQ ID NO: 1148 - RNA, 19 nt, Artificial Sequence
  Description of Artificial Sequence: Synthetic oligonucleotide
accgccugggugagcacaa

SEQ ID NO: 1149 - RNA, 19 nt, Artificial Sequence
  Description of Artificial Sequence: Synthetic oligonucleotide
ccgccugggugagcacaau

SEQ ID NO: 1150 - RNA, 19 nt, Artificial Sequence
  Description of Artificial Sequence: Synthetic oligonucleotide
cgccugggugagcacaaua

SEQ ID NO: 1151 - RNA, 19 nt, Artificial Sequence
  Description of Artificial Sequence: Synthetic oligonucleotide
gccugggugagcacaauaa

SEQ ID NO: 1152 - RNA, 19 nt, Artificial Sequence
  Description of Artificial Sequence: Synthetic oligonucleotide
ccugggugagcacaauaag

SEQ ID NO: 1153 - RNA, 19 nt, Artificial Sequence
  Description of Artificial Sequence: Synthetic oligonucleotide
cugggugagcacaauaagc

SEQ ID NO: 1154 - RNA, 19 nt, Artificial Sequence
  Description of Artificial Sequence: Synthetic oligonucleotide
ugggugagcacaauaagca

SEQ ID NO: 1155 - RNA, 19 nt, Artificial Sequence
  Description of Artificial Sequence: Synthetic oligonucleotide
gggugagcacaauaagcac

SEQ ID NO: 1156 - RNA, 19 nt, Artificial Sequence
  Description of Artificial Sequence: Synthetic oligonucleotide
ggugagcacaauaagcacc

SEQ ID NO: 1157 - RNA, 19 nt, Artificial Sequence
  Description of Artificial Sequence: Synthetic oligonucleotide
gugagcacaauaagcaccu

SEQ ID NO: 1158 - RNA, 19 nt, Artificial Sequence
  Description of Artificial Sequence: Synthetic oligonucleotide
ugagcacaauaagcaccug

SEQ ID NO: 1159 - RNA, 19 nt, Artificial Sequence
  Description of Artificial Sequence: Synthetic oligonucleotide
gagcacaauaagcaccugg

SEQ ID NO: 1160 - RNA, 19 nt, Artificial Sequence
  Description of Artificial Sequence: Synthetic oligonucleotide
agcacaauaagcaccugga

SEQ ID NO: 1161 - RNA, 19 nt, Artificial Sequence
  Description of Artificial Sequence: Synthetic oligonucleotide
gcacaauaagcaccuggau

SEQ ID NO: 1162 - RNA, 19 nt, Artificial Sequence
  Description of Artificial Sequence: Synthetic oligonucleotide
cacaauaagcaccuggaug

SEQ ID NO: 1163 - RNA, 19 nt, Artificial Sequence
  Description of Artificial Sequence: Synthetic oligonucleotide
acaauaagcaccuggaugg

SEQ ID NO: 1164 - RNA, 19 nt, Artificial Sequence
  Description of Artificial Sequence: Synthetic oligonucleotide
caauaagcaccuggauggc

SEQ ID NO: 1165 - RNA, 19 nt, Artificial Sequence
  Description of Artificial Sequence: Synthetic oligonucleotide
aauaagcaccuggauggca

SEQ ID NO: 1166 - RNA, 19 nt, Artificial Sequence
  Description of Artificial Sequence: Synthetic oligonucleotide
auaagcaccuggauggcau

SEQ ID NO: 1167 - RNA, 19 nt, Artificial Sequence
  Description of Artificial Sequence: Synthetic oligonucleotide
uaagcaccuggauggcauc

SEQ ID NO: 1168 - RNA, 19 nt, Artificial Sequence
  Description of Artificial Sequence: Synthetic oligonucleotide
aagcaccuggauggcauca

SEQ ID NO: 1169 - RNA, 19 nt, Artificial Sequence
  Description of Artificial Sequence: Synthetic oligonucleotide
agcaccuggauggcaucac

SEQ ID NO: 1170 - RNA, 19 nt, Artificial Sequence
  Description of Artificial Sequence: Synthetic oligonucleotide
gcaccuggauggcaucacc

SEQ ID NO: 1171 - RNA, 19 nt, Artificial Sequence
  Description of Artificial Sequence: Synthetic oligonucleotide
caccuggauggcaucaccu

SEQ ID NO: 1172 - RNA, 19 nt, Artificial Sequence
  Description of Artificial Sequence: Synthetic oligonucleotide
accuggauggcaucaccug

SEQ ID NO: 1173 - RNA, 19 nt, Artificial Sequence
  Description of Artificial Sequence: Synthetic oligonucleotide
ccuggauggcaucaccugg

SEQ ID NO: 1174 - RNA, 19 nt, Artificial Sequence
  Description of Artificial Sequence: Synthetic oligonucleotide
cuggauggcaucaccuggu

SEQ ID NO: 1175 - RNA, 19 nt, Artificial Sequence
  Description of Artificial Sequence: Synthetic oligonucleotide
uggauggcaucaccuggua

SEQ ID NO: 1176 - RNA, 19 nt, Artificial Sequence
  Description of Artificial Sequence: Synthetic oligonucleotide
ggauggcaucaccugguau

SEQ ID NO: 1177 - RNA, 19 nt, Artificial Sequence
  Description of Artificial Sequence: Synthetic oligonucleotide
gauggcaucaccugguaug

SEQ ID NO: 1178 - RNA, 19 nt, Artificial Sequence
  Description of Artificial Sequence: Synthetic oligonucleotide
auggcaucaccugguaugg

SEQ ID NO: 1179 - RNA, 19 nt, Artificial Sequence
  Description of Artificial Sequence: Synthetic oligonucleotide
uggcaucaccugguauggc

SEQ ID NO: 1180 - RNA, 19 nt, Artificial Sequence
  Description of Artificial Sequence: Synthetic oligonucleotide
ggcaucaccugguauggcu

SEQ ID NO: 1181 - RNA, 19 nt, Artificial Sequence
  Description of Artificial Sequence: Synthetic oligonucleotide
gcaucaccugguauggcug

SEQ ID NO: 1182 - RNA, 19 nt, Artificial Sequence
  Description of Artificial Sequence: Synthetic oligonucleotide
caucaccugguauggcugg

SEQ ID NO: 1183 - RNA, 19 nt, Artificial Sequence
  Description of Artificial Sequence: Synthetic oligonucleotide
aucaccugguauggcuggc

SEQ ID NO: 1184 - RNA, 19 nt, Artificial Sequence
  Description of Artificial Sequence: Synthetic oligonucleotide
ucaccugguauggcuggca

SEQ ID NO: 1185 - RNA, 19 nt, Artificial Sequence
  Description of Artificial Sequence: Synthetic oligonucleotide
caccugguauggcuggcau

SEQ ID NO: 1186 - RNA, 19 nt, Artificial Sequence
  Description of Artificial Sequence: Synthetic oligonucleotide
accugguauggcuggcaug

SEQ ID NO: 1187 - RNA, 19 nt, Artificial Sequence
  Description of Artificial Sequence: Synthetic oligonucleotide
ccugguauggcuggcaugg

SEQ ID NO: 1188 - RNA, 19 nt, Artificial Sequence
  Description of Artificial Sequence: Synthetic oligonucleotide
cugguauggcuggcaugga

SEQ ID NO: 1189 - RNA, 19 nt, Artificial Sequence
  Description of Artificial Sequence: Synthetic oligonucleotide
ugguauggcuggcauggau

SEQ ID NO: 1190 - RNA, 19 nt, Artificial Sequence
  Description of Artificial Sequence: Synthetic oligonucleotide
gguauggcuggcauggauc

SEQ ID NO: 1191 - RNA, 19 nt, Artificial Sequence
  Description of Artificial Sequence: Synthetic oligonucleotide
guauggcuggcauggaucu

SEQ ID NO: 1192 - RNA, 19 nt, Artificial Sequence
  Description of Artificial Sequence: Synthetic oligonucleotide
uauggcuggcauggaucua

SEQ ID NO: 1193 - RNA, 19 nt, Artificial Sequence
  Description of Artificial Sequence: Synthetic oligonucleotide
auggcuggcauggaucuac

SEQ ID NO: 1194 - RNA, 19 nt, Artificial Sequence
  Description of Artificial Sequence: Synthetic oligonucleotide
uggcuggcauggaucuacc

SEQ ID NO: 1195 - RNA, 19 nt, Artificial Sequence
  Description of Artificial Sequence: Synthetic oligonucleotide
ggcuggcauggaucuaccu

SEQ ID NO: 1196 - RNA, 19 nt, Artificial Sequence
  Description of Artificial Sequence: Synthetic oligonucleotide
gcuggcauggaucuaccua

SEQ ID NO: 1197 - RNA, 19 nt, Artificial Sequence
  Description of Artificial Sequence: Synthetic oligonucleotide
cuggcauggaucuaccuac

SEQ ID NO: 1198 - RNA, 19 nt, Artificial Sequence
  Description of Artificial Sequence: Synthetic oligonucleotide
uggcauggaucuaccuacu

SEQ ID NO: 1199 - RNA, 19 nt, Artificial Sequence
  Description of Artificial Sequence: Synthetic oligonucleotide
ggcauggaucuaccuacuc

SEQ ID NO: 1200 - RNA, 19 nt, Artificial Sequence
  Description of Artificial Sequence: Synthetic oligonucleotide
gcauggaucuaccuacucc

SEQ ID NO: 1201 - RNA, 19 nt, Artificial Sequence
  Description of Artificial Sequence: Synthetic oligonucleotide
cauggaucuaccuacuccc

SEQ ID NO: 1202 - RNA, 19 nt, Artificial Sequence
  Description of Artificial Sequence: Synthetic oligonucleotide
auggaucuaccuacucccu

SEQ ID NO: 1203 - RNA, 19 nt, Artificial Sequence
  Description of Artificial Sequence: Synthetic oligonucleotide
uggaucuaccuacucccuc

SEQ ID NO: 1204 - RNA, 19 nt, Artificial Sequence
  Description of Artificial Sequence: Synthetic oligonucleotide
ggaucuaccuacucccuca

SEQ ID NO: 1205 - RNA, 19 nt, Artificial Sequence
  Description of Artificial Sequence: Synthetic oligonucleotide
gaucuaccuacucccucaa

SEQ ID NO: 1206 - RNA, 19 nt, Artificial Sequence
  Description of Artificial Sequence: Synthetic oligonucleotide
aucuaccuacucccucaaa

SEQ ID NO: 1207 - RNA, 19 nt, Artificial Sequence
  Description of Artificial Sequence: Synthetic oligonucleotide
ucuaccuacucccucaaac

SEQ ID NO: 1208 - RNA, 19 nt, Artificial Sequence
  Description of Artificial Sequence: Synthetic oligonucleotide
cuaccuacucccucaaacg

SEQ ID NO: 1209 - RNA, 19 nt, Artificial Sequence
  Description of Artificial Sequence: Synthetic oligonucleotide
uaccuacucccucaaacgg

SEQ ID NO: 1210 - RNA, 19 nt, Artificial Sequence
  Description of Artificial Sequence: Synthetic oligonucleotide
accuacucccucaaacggg

SEQ ID NO: 1211 - RNA, 19 nt, Artificial Sequence
  Description of Artificial Sequence: Synthetic oligonucleotide
ccuacucccucaaacgggu

SEQ ID NO: 1212 - RNA, 19 nt, Artificial Sequence
  Description of Artificial Sequence: Synthetic oligonucleotide
cuacucccucaaacgggug

SEQ ID NO: 1213 - RNA, 19 nt, Artificial Sequence
  Description of Artificial Sequence: Synthetic oligonucleotide
uacucccucaaacgggugg

SEQ ID NO: 1214 - RNA, 19 nt, Artificial Sequence
  Description of Artificial Sequence: Synthetic oligonucleotide
acucccucaaacgggugga

SEQ ID NO: 1215 - RNA, 19 nt, Artificial Sequence
  Description of Artificial Sequence: Synthetic oligonucleotide
cucccucaaacggguggag

SEQ ID NO: 1216 - RNA, 19 nt, Artificial Sequence
  Description of Artificial Sequence: Synthetic oligonucleotide
ucccucaaacggguggaga

SEQ ID NO: 1217 - RNA, 19 nt, Artificial Sequence
  Description of Artificial Sequence: Synthetic oligonucleotide
cccucaaacggguggagau

SEQ ID NO: 1218 - RNA, 19 nt, Artificial Sequence
  Description of Artificial Sequence: Synthetic oligonucleotide
ccucaaacggguggagaug

SEQ ID NO: 1219 - RNA, 19 nt, Artificial Sequence
  Description of Artificial Sequence: Synthetic oligonucleotide
cucaaacggguggagauga

SEQ ID NO: 1220 - RNA, 19 nt, Artificial Sequence
  Description of Artificial Sequence: Synthetic oligonucleotide
ucaaacggguggagaugaa

SEQ ID NO: 1221 - RNA, 19 nt, Artificial Sequence
  Description of Artificial Sequence: Synthetic oligonucleotide
caaacggguggagaugaaa

SEQ ID NO: 1222 - RNA, 19 nt, Artificial Sequence
  Description of Artificial Sequence: Synthetic oligonucleotide
aaacggguggagaugaaaa

SEQ ID NO: 1223 - RNA, 19 nt, Artificial Sequence
  Description of Artificial Sequence: Synthetic oligonucleotide
aacggguggagaugaaaau

SEQ ID NO: 1224 - RNA, 19 nt, Artificial Sequence
  Description of Artificial Sequence: Synthetic oligonucleotide
acggguggagaugaaaauc

SEQ ID NO: 1225 - RNA, 19 nt, Artificial Sequence
  Description of Artificial Sequence: Synthetic oligonucleotide
cggguggagaugaaaaucc

SEQ ID NO: 1226 - RNA, 19 nt, Artificial Sequence
  Description of Artificial Sequence: Synthetic oligonucleotide
ggguggagaugaaaauccg

SEQ ID NO: 1227 - RNA, 19 nt, Artificial Sequence
  Description of Artificial Sequence: Synthetic oligonucleotide
gguggagaugaaaauccgc

SEQ ID NO: 1228 - RNA, 19 nt, Artificial Sequence
  Description of Artificial Sequence: Synthetic oligonucleotide
guggagaugaaaauccgcc

SEQ ID NO: 1229 - RNA, 19 nt, Artificial Sequence
  Description of Artificial Sequence: Synthetic oligonucleotide
uggagaugaaaauccgccc

SEQ ID NO: 1230 - RNA, 19 nt, Artificial Sequence
  Description of Artificial Sequence: Synthetic oligonucleotide
ggagaugaaaauccgccca

SEQ ID NO: 1231 - RNA, 19 nt, Artificial Sequence
  Description of Artificial Sequence: Synthetic oligonucleotide
gagaugaaaauccgcccag

SEQ ID NO: 1232 - RNA, 19 nt, Artificial Sequence
  Description of Artificial Sequence: Synthetic oligonucleotide
agaugaaaauccgcccaga

SEQ ID NO: 1233 - RNA, 19 nt, Artificial Sequence
  Description of Artificial Sequence: Synthetic oligonucleotide
gaugaaaauccgcccagaa

SEQ ID NO: 1234 - RNA, 19 nt, Artificial Sequence
  Description of Artificial Sequence: Synthetic oligonucleotide
augaaaauccgcccagaag

SEQ ID NO: 1235 - RNA, 19 nt, Artificial Sequence
  Description of Artificial Sequence: Synthetic oligonucleotide
ugaaaauccgcccagaaga

SEQ ID NO: 1236 - RNA, 19 nt, Artificial Sequence
  Description of Artificial Sequence: Synthetic oligonucleotide
gaaaauccgcccagaagac

SEQ ID NO: 1237 - RNA, 19 nt, Artificial Sequence
  Description of Artificial Sequence: Synthetic oligonucleotide
aaaauccgcccagaagacu

SEQ ID NO: 1238 - RNA, 19 nt, Artificial Sequence
  Description of Artificial Sequence: Synthetic oligonucleotide
aaauccgcccagaagacuu

SEQ ID NO: 1239 - RNA, 19 nt, Artificial Sequence
  Description of Artificial Sequence: Synthetic oligonucleotide
aauccgcccagaagacuuc

SEQ ID NO: 1240 - RNA, 19 nt, Artificial Sequence
  Description of Artificial Sequence: Synthetic oligonucleotide
auccgcccagaagacuuca

SEQ ID NO: 1241 - RNA, 19 nt, Artificial Sequence
  Description of Artificial Sequence: Synthetic oligonucleotide
uccgcccagaagacuucaa

SEQ ID NO: 1242 - RNA, 19 nt, Artificial Sequence
  Description of Artificial Sequence: Synthetic oligonucleotide
ccgcccagaagacuucaag

SEQ ID NO: 1243 - RNA, 19 nt, Artificial Sequence
  Description of Artificial Sequence: Synthetic oligonucleotide
cgcccagaagacuucaagc

SEQ ID NO: 1244 - RNA, 19 nt, Artificial Sequence
  Description of Artificial Sequence: Synthetic oligonucleotide
gcccagaagacuucaagcc

SEQ ID NO: 1245 - RNA, 19 nt, Artificial Sequence
  Description of Artificial Sequence: Synthetic oligonucleotide
cccagaagacuucaagccu

SEQ ID NO: 1246 - RNA, 19 nt, Artificial Sequence
  Description of Artificial Sequence: Synthetic oligonucleotide
ccagaagacuucaagccuu

SEQ ID NO: 1247 - RNA, 19 nt, Artificial Sequence
  Description of Artificial Sequence: Synthetic oligonucleotide
cagaagacuucaagccuua

SEQ ID NO: 1248 - RNA, 19 nt, Artificial Sequence
  Description of Artificial Sequence: Synthetic oligonucleotide
agaagacuucaagccuuaa

SEQ ID NO: 1249 - RNA, 19 nt, Artificial Sequence
  Description of Artificial Sequence: Synthetic oligonucleotide
gaagacuucaagccuuaaa

SEQ ID NO: 1250 - RNA, 19 nt, Artificial Sequence
  Description of Artificial Sequence: Synthetic oligonucleotide
aagacuucaagccuuaaaa

SEQ ID NO: 1251 - RNA, 19 nt, Artificial Sequence
  Description of Artificial Sequence: Synthetic oligonucleotide
agacuucaagccuuaaaag

SEQ ID NO: 1252 - RNA, 19 nt, Artificial Sequence
  Description of Artificial Sequence: Synthetic oligonucleotide
gacuucaagccuuaaaagg

SEQ ID NO: 1253 - RNA, 19 nt, Artificial Sequence
  Description of Artificial Sequence: Synthetic oligonucleotide
acuucaagccuuaaaagga

SEQ ID NO: 1254 - RNA, 19 nt, Artificial Sequence
  Description of Artificial Sequence: Synthetic oligonucleotide
cuucaagccuuaaaaggag

SEQ ID NO: 1255 - RNA, 19 nt, Artificial Sequence
  Description of Artificial Sequence: Synthetic oligonucleotide
uucaagccuuaaaaggagg

SEQ ID NO: 1256 - RNA, 19 nt, Artificial Sequence
  Description of Artificial Sequence: Synthetic oligonucleotide
ucaagccuuaaaaggaggc

SEQ ID NO: 1257 - RNA, 19 nt, Artificial Sequence
  Description of Artificial Sequence: Synthetic oligonucleotide
caagccuuaaaaggaggcu

SEQ ID NO: 1258 - RNA, 19 nt, Artificial Sequence
  Description of Artificial Sequence: Synthetic oligonucleotide
aagccuuaaaaggaggcug

SEQ ID NO: 1259 - RNA, 19 nt, Artificial Sequence
  Description of Artificial Sequence: Synthetic oligonucleotide
agccuuaaaaggaggcugc

SEQ ID NO: 1260 - RNA, 19 nt, Artificial Sequence
  Description of Artificial Sequence: Synthetic oligonucleotide
gccuuaaaaggaggcugcc

SEQ ID NO: 1261 - RNA, 19 nt, Artificial Sequence
  Description of Artificial Sequence: Synthetic oligonucleotide
ccuuaaaaggaggcugccg

SEQ ID NO: 1262 - RNA, 19 nt, Artificial Sequence
  Description of Artificial Sequence: Synthetic oligonucleotide
cuuaaaaggaggcugccgu

SEQ ID NO: 1263 - RNA, 19 nt, Artificial Sequence
  Description of Artificial Sequence: Synthetic oligonucleotide
uuaaaaggaggcugccgug

SEQ ID NO: 1264 - RNA, 19 nt, Artificial Sequence
  Description of Artificial Sequence: Synthetic oligonucleotide
uaaaaggaggcugccgugg

SEQ ID NO: 1265 - RNA, 19 nt, Artificial Sequence
  Description of Artificial Sequence: Synthetic oligonucleotide
aaaaggaggcugccgugga

SEQ ID NO: 1266 - RNA, 19 nt, Artificial Sequence
  Description of Artificial Sequence: Synthetic oligonucleotide
aaaggaggcugccguggag

SEQ ID NO: 1267 - RNA, 19 nt, Artificial Sequence
  Description of Artificial Sequence: Synthetic oligonucleotide
aaggaggcugccguggagc

SEQ ID NO: 1268 - RNA, 19 nt, Artificial Sequence
  Description of Artificial Sequence: Synthetic oligonucleotide
aggaggcugccguggagca

SEQ ID NO: 1269 - RNA, 19 nt, Artificial Sequence
  Description of Artificial Sequence: Synthetic oligonucleotide
ggaggcugccguggagcac

SEQ ID NO: 1270 - RNA, 19 nt, Artificial Sequence
  Description of Artificial Sequence: Synthetic oligonucleotide
gaggcugccguggagcacg

SEQ ID NO: 1271 - RNA, 19 nt, Artificial Sequence
  Description of Artificial Sequence: Synthetic oligonucleotide
aggcugccguggagcacgg

SEQ ID NO: 1272 - RNA, 19 nt, Artificial Sequence
  Description of Artificial Sequence: Synthetic oligonucleotide
ggcugccguggagcacgga

SEQ ID NO: 1273 - RNA, 19 nt, Artificial Sequence
  Description of Artificial Sequence: Synthetic oligonucleotide
gcugccguggagcacggau

SEQ ID NO: 1274 - RNA, 19 nt, Artificial Sequence
  Description of Artificial Sequence: Synthetic oligonucleotide
cugccguggagcacggaua

SEQ ID NO: 1275 - RNA, 19 nt, Artificial Sequence
  Description of Artificial Sequence: Synthetic oligonucleotide
ugccguggagcacggauac

SEQ ID NO: 1276 - RNA, 19 nt, Artificial Sequence
  Description of Artificial Sequence: Synthetic oligonucleotide
gccguggagcacggauaca

SEQ ID NO: 1277 - RNA, 19 nt, Artificial Sequence
  Description of Artificial Sequence: Synthetic oligonucleotide
ccguggagcacggauacag

SEQ ID NO: 1278 - RNA, 19 nt, Artificial Sequence
  Description of Artificial Sequence: Synthetic oligonucleotide
cguggagcacggauacaga

SEQ ID NO: 1279 - RNA, 19 nt, Artificial Sequence
  Description of Artificial Sequence: Synthetic oligonucleotide
guggagcacggauacagaa

SEQ ID NO: 1280 - RNA, 19 nt, Artificial Sequence
  Description of Artificial Sequence: Synthetic oligonucleotide
uggagcacggauacagaaa

SEQ ID NO: 1281 - RNA, 19 nt, Artificial Sequence
  Description of Artificial Sequence: Synthetic oligonucleotide
ggagcacggauacagaaac

SEQ ID NO: 1282 - RNA, 19 nt, Artificial Sequence
  Description of Artificial Sequence: Synthetic oligonucleotide
gagcacggauacagaaacu

SEQ ID NO: 1283 - RNA, 19 nt, Artificial Sequence
  Description of Artificial Sequence: Synthetic oligonucleotide
agcacggauacagaaacug

SEQ ID NO: 1284 - RNA, 19 nt, Artificial Sequence
  Description of Artificial Sequence: Synthetic oligonucleotide
gcacggauacagaaacuga

SEQ ID NO: 1285 - RNA, 19 nt, Artificial Sequence
  Description of Artificial Sequence: Synthetic oligonucleotide
cacggauacagaaacugag

SEQ ID NO: 1286 - RNA, 19 nt, Artificial Sequence
  Description of Artificial Sequence: Synthetic oligonucleotide
acggauacagaaacugaga

SEQ ID NO: 1287 - RNA, 19 nt, Artificial Sequence
  Description of Artificial Sequence: Synthetic oligonucleotide
cggauacagaaacugagac

SEQ ID NO: 1288 - RNA, 19 nt, Artificial Sequence
  Description of Artificial Sequence: Synthetic oligonucleotide
ggauacagaaacugagaca

SEQ ID NO: 1289 - RNA, 19 nt, Artificial Sequence
  Description of Artificial Sequence: Synthetic oligonucleotide
gauacagaaacugagacac

SEQ ID NO: 1290 - RNA, 19 nt, Artificial Sequence
  Description of Artificial Sequence: Synthetic oligonucleotide
auacagaaacugagacacg

SEQ ID NO: 1291 - RNA, 19 nt, Artificial Sequence
  Description of Artificial Sequence: Synthetic oligonucleotide
uacagaaacugagacacgu

SEQ ID NO: 1292 - RNA, 19 nt, Artificial Sequence
  Description of Artificial Sequence: Synthetic oligonucleotide
acagaaacugagacacgug

SEQ ID NO: 1293 - RNA, 19 nt, Artificial Sequence
  Description of Artificial Sequence: Synthetic oligonucleotide
cagaaacugagacacgugg

SEQ ID NO: 1294 - RNA, 19 nt, Artificial Sequence
  Description of Artificial Sequence: Synthetic oligonucleotide
agaaacugagacacgugga

SEQ ID NO: 1295 - RNA, 19 nt, Artificial Sequence
  Description of Artificial Sequence: Synthetic oligonucleotide
gaaacugagacacguggag

SEQ ID NO: 1296 - RNA, 19 nt, Artificial Sequence
  Description of Artificial Sequence: Synthetic oligonucleotide
aaacugagacacguggaga

SEQ ID NO: 1297 - RNA, 19 nt, Artificial Sequence
  Description of Artificial Sequence: Synthetic oligonucleotide
aacugagacacguggagac

SEQ ID NO: 1298 - RNA, 19 nt, Artificial Sequence
  Description of Artificial Sequence: Synthetic oligonucleotide
acugagacacguggagacu

SEQ ID NO: 1299 - RNA, 19 nt, Artificial Sequence
  Description of Artificial Sequence: Synthetic oligonucleotide
cugagacacguggagacug

SEQ ID NO: 1300 - RNA, 19 nt, Artificial Sequence
  Description of Artificial Sequence: Synthetic oligonucleotide
ugagacacguggagacugg

SEQ ID NO: 1301 - RNA, 19 nt, Artificial Sequence
  Description of Artificial Sequence: Synthetic oligonucleotide
gagacacguggagacugga

SEQ ID NO: 1302 - RNA, 19 nt, Artificial Sequence
  Description of Artificial Sequence: Synthetic oligonucleotide
agacacguggagacuggau

SEQ ID NO: 1303 - RNA, 19 nt, Artificial Sequence
  Description of Artificial Sequence: Synthetic oligonucleotide
gacacguggagacuggaug

SEQ ID NO: 1304 - RNA, 19 nt, Artificial Sequence
  Description of Artificial Sequence: Synthetic oligonucleotide
acacguggagacuggauga

SEQ ID NO: 1305 - RNA, 19 nt, Artificial Sequence
  Description of Artificial Sequence: Synthetic oligonucleotide
cacguggagacuggaugag

SEQ ID NO: 1306 - RNA, 19 nt, Artificial Sequence
  Description of Artificial Sequence: Synthetic oligonucleotide
acguggagacuggaugagg

SEQ ID NO: 1307 - RNA, 19 nt, Artificial Sequence
  Description of Artificial Sequence: Synthetic oligonucleotide
cguggagacuggaugaggg

SEQ ID NO: 1308 - RNA, 19 nt, Artificial Sequence
  Description of Artificial Sequence: Synthetic oligonucleotide
guggagacuggaugagggc

SEQ ID NO: 1309 - RNA, 19 nt, Artificial Sequence
  Description of Artificial Sequence: Synthetic oligonucleotide
uggagacuggaugagggca

SEQ ID NO: 1310 - RNA, 19 nt, Artificial Sequence
  Description of Artificial Sequence: Synthetic oligonucleotide
ggagacuggaugagggcag

SEQ ID NO: 1311 - RNA, 19 nt, Artificial Sequence
  Description of Artificial Sequence: Synthetic oligonucleotide
gagacuggaugagggcaga

SEQ ID NO: 1312 - RNA, 19 nt, Artificial Sequence
  Description of Artificial Sequence: Synthetic oligonucleotide
agacuggaugagggcagau

SEQ ID NO: 1313 - RNA, 19 nt, Artificial Sequence
  Description of Artificial Sequence: Synthetic oligonucleotide
gacuggaugagggcagaug

SEQ ID NO: 1314 - RNA, 19 nt, Artificial Sequence
  Description of Artificial Sequence: Synthetic oligonucleotide
acuggaugagggcagauga

SEQ ID NO: 1315 - RNA, 19 nt, Artificial Sequence
  Description of Artificial Sequence: Synthetic oligonucleotide
cuggaugagggcagaugag

SEQ ID NO: 1316 - RNA, 19 nt, Artificial Sequence
  Description of Artificial Sequence: Synthetic oligonucleotide
uggaugagggcagaugagg

SEQ ID NO: 1317 - RNA, 19 nt, Artificial Sequence
  Description of Artificial Sequence: Synthetic oligonucleotide
ggaugagggcagaugagga

SEQ ID NO: 1318 - RNA, 19 nt, Artificial Sequence
  Description of Artificial Sequence: Synthetic oligonucleotide
gaugagggcagaugaggac

SEQ ID NO: 1319 - RNA, 19 nt, Artificial Sequence
  Description of Artificial Sequence: Synthetic oligonucleotide
augagggcagaugaggaca

SEQ ID NO: 1320 - RNA, 19 nt, Artificial Sequence
  Description of Artificial Sequence: Synthetic oligonucleotide
ugagggcagaugaggacag

SEQ ID NO: 1321 - RNA, 19 nt, Artificial Sequence
  Description of Artificial Sequence: Synthetic oligonucleotide
gagggcagaugaggacagg

SEQ ID NO: 1322 - RNA, 19 nt, Artificial Sequence
  Description of Artificial Sequence: Synthetic oligonucleotide
agggcagaugaggacagga

SEQ ID NO: 1323 - RNA, 19 nt, Artificial Sequence
  Description of Artificial Sequence: Synthetic oligonucleotide
gggcagaugaggacaggaa

SEQ ID NO: 1324 - RNA, 19 nt, Artificial Sequence
  Description of Artificial Sequence: Synthetic oligonucleotide
ggcagaugaggacaggaag

SEQ ID NO: 1325 - RNA, 19 nt, Artificial Sequence
  Description of Artificial Sequence: Synthetic oligonucleotide
gcagaugaggacaggaaga

SEQ ID NO: 1326 - RNA, 19 nt, Artificial Sequence
  Description of Artificial Sequence: Synthetic oligonucleotide
cagaugaggacaggaagag

SEQ ID NO: 1327 - RNA, 19 nt, Artificial Sequence
  Description of Artificial Sequence: Synthetic oligonucleotide
agaugaggacaggaagaga

SEQ ID NO: 1328 - RNA, 19 nt, Artificial Sequence
  Description of Artificial Sequence: Synthetic oligonucleotide
gaugaggacaggaagagag

SEQ ID NO: 1329 - RNA, 19 nt, Artificial Sequence
  Description of Artificial Sequence: Synthetic oligonucleotide
augaggacaggaagagagu

SEQ ID NO: 1330 - RNA, 19 nt, Artificial Sequence
  Description of Artificial Sequence: Synthetic oligonucleotide
ugaggacaggaagagagug

SEQ ID NO: 1331 - RNA, 19 nt, Artificial Sequence
  Description of Artificial Sequence: Synthetic oligonucleotide
gaggacaggaagagagugu

SEQ ID NO: 1332 - RNA, 19 nt, Artificial Sequence
  Description of Artificial Sequence: Synthetic oligonucleotide
aggacaggaagagaguguu

SEQ ID NO: 1333 - RNA, 19 nt, Artificial Sequence
  Description of Artificial Sequence: Synthetic oligonucleotide
ggacaggaagagaguguua

SEQ ID NO: 1334 - RNA, 19 nt, Artificial Sequence
  Description of Artificial Sequence: Synthetic oligonucleotide
gacaggaagagaguguuag

SEQ ID NO: 1335 - RNA, 19 nt, Artificial Sequence
  Description of Artificial Sequence: Synthetic oligonucleotide
acaggaagagaguguuaga

SEQ ID NO: 1336 - RNA, 19 nt, Artificial Sequence
  Description of Artificial Sequence: Synthetic oligonucleotide
caggaagagaguguuagaa

SEQ ID NO: 1337 - RNA, 19 nt, Artificial Sequence
  Description of Artificial Sequence: Synthetic oligonucleotide
aggaagagaguguuagaaa

SEQ ID NO: 1338 - RNA, 19 nt, Artificial Sequence
  Description of Artificial Sequence: Synthetic oligonucleotide
ggaagagaguguuagaaag

SEQ ID NO: 1339 - RNA, 19 nt, Artificial Sequence
  Description of Artificial Sequence: Synthetic oligonucleotide
gaagagaguguuagaaagg

SEQ ID NO: 1340 - RNA, 19 nt, Artificial Sequence
  Description of Artificial Sequence: Synthetic oligonucleotide
aagagaguguuagaaaggg

SEQ ID NO: 1341 - RNA, 19 nt, Artificial Sequence
  Description of Artificial Sequence: Synthetic oligonucleotide
agagaguguuagaaagggu

SEQ ID NO: 1342 - RNA, 19 nt, Artificial Sequence
  Description of Artificial Sequence: Synthetic oligonucleotide
gagaguguuagaaagggua

SEQ ID NO: 1343 - RNA, 19 nt, Artificial Sequence
  Description of Artificial Sequence: Synthetic oligonucleotide
agaguguuagaaaggguag

SEQ ID NO: 1344 - RNA, 19 nt, Artificial Sequence
  Description of Artificial Sequence: Synthetic oligonucleotide
gaguguuagaaaggguagg

SEQ ID NO: 1345 - RNA, 19 nt, Artificial Sequence
  Description of Artificial Sequence: Synthetic oligonucleotide
aguguuagaaaggguagga

SEQ ID NO: 1346 - RNA, 19 nt, Artificial Sequence
  Description of Artificial Sequence: Synthetic oligonucleotide
guguuagaaaggguaggac

SEQ ID NO: 1347 - RNA, 19 nt, Artificial Sequence
  Description of Artificial Sequence: Synthetic oligonucleotide
uguuagaaaggguaggacu

SEQ ID NO: 1348 - RNA, 19 nt, Artificial Sequence
  Description of Artificial Sequence: Synthetic oligonucleotide
guuagaaaggguaggacug

SEQ ID NO: 1349 - RNA, 19 nt, Artificial Sequence
  Description of Artificial Sequence: Synthetic oligonucleotide
uuagaaaggguaggacuga

SEQ ID NO: 1350 - RNA, 19 nt, Artificial Sequence
  Description of Artificial Sequence: Synthetic oligonucleotide
uagaaaggguaggacugag

SEQ ID NO: 1351 - RNA, 19 nt, Artificial Sequence
  Description of Artificial Sequence: Synthetic oligonucleotide
agaaaggguaggacugaga

SEQ ID NO: 1352 - RNA, 19 nt, Artificial Sequence
  Description of Artificial Sequence: Synthetic oligonucleotide
gaaaggguaggacugagaa

SEQ ID NO: 1353 - RNA, 19 nt, Artificial Sequence
  Description of Artificial Sequence: Synthetic oligonucleotide
aaaggguaggacugagaaa

SEQ ID NO: 1354 - RNA, 19 nt, Artificial Sequence
  Description of Artificial Sequence: Synthetic oligonucleotide
aaggguaggacugagaaac

SEQ ID NO: 1355 - RNA, 19 nt, Artificial Sequence
  Description of Artificial Sequence: Synthetic oligonucleotide
aggguaggacugagaaaca

SEQ ID NO: 1356 - RNA, 19 nt, Artificial Sequence
  Description of Artificial Sequence: Synthetic oligonucleotide
ggguaggacugagaaacag

SEQ ID NO: 1357 - RNA, 19 nt, Artificial Sequence
  Description of Artificial Sequence: Synthetic oligonucleotide
gguaggacugagaaacagc

SEQ ID NO: 1358 - RNA, 19 nt, Artificial Sequence
  Description of Artificial Sequence: Synthetic oligonucleotide
guaggacugagaaacagcc

SEQ ID NO: 1359 - RNA, 19 nt, Artificial Sequence
  Description of Artificial Sequence: Synthetic oligonucleotide
uaggacugagaaacagccu

SEQ ID NO: 1360 - RNA, 19 nt, Artificial Sequence
  Description of Artificial Sequence: Synthetic oligonucleotide
aggacugagaaacagccua

SEQ ID NO: 1361 - RNA, 19 nt, Artificial Sequence
  Description of Artificial Sequence: Synthetic oligonucleotide
ggacugagaaacagccuau

SEQ ID NO: 1362 - RNA, 19 nt, Artificial Sequence
  Description of Artificial Sequence: Synthetic oligonucleotide
gacugagaaacagccuaua

SEQ ID NO: 1363 - RNA, 19 nt, Artificial Sequence
  Description of Artificial Sequence: Synthetic oligonucleotide
acugagaaacagccuauaa

SEQ ID NO: 1364 - RNA, 19 nt, Artificial Sequence
  Description of Artificial Sequence: Synthetic oligonucleotide
cugagaaacagccuauaau

SEQ ID NO: 1365 - RNA, 19 nt, Artificial Sequence
  Description of Artificial Sequence: Synthetic oligonucleotide
ugagaaacagccuauaauc

SEQ ID NO: 1366 - RNA, 19 nt, Artificial Sequence
  Description of Artificial Sequence: Synthetic oligonucleotide
gagaaacagccuauaaucu

SEQ ID NO: 1367 - RNA, 19 nt, Artificial Sequence
  Description of Artificial Sequence: Synthetic oligonucleotide
agaaacagccuauaaucuc

SEQ ID NO: 1368 - RNA, 19 nt, Artificial Sequence
  Description of Artificial Sequence: Synthetic oligonucleotide
gaaacagccuauaaucucc

SEQ ID NO: 1369 - RNA, 19 nt, Artificial Sequence
  Description of Artificial Sequence: Synthetic oligonucleotide
aaacagccuauaaucucca

SEQ ID NO: 1370 - RNA, 19 nt, Artificial Sequence
  Description of Artificial Sequence: Synthetic oligonucleotide
aacagccuauaaucuccaa

SEQ ID NO: 1371 - RNA, 19 nt, Artificial Sequence
  Description of Artificial Sequence: Synthetic oligonucleotide
acagccuauaaucuccaaa

SEQ ID NO: 1372 - RNA, 19 nt, Artificial Sequence
  Description of Artificial Sequence: Synthetic oligonucleotide
cagccuauaaucuccaaag

SEQ ID NO: 1373 - RNA, 19 nt, Artificial Sequence
  Description of Artificial Sequence: Synthetic oligonucleotide
agccuauaaucuccaaaga

SEQ ID NO: 1374 - RNA, 19 nt, Artificial Sequence
  Description of Artificial Sequence: Synthetic oligonucleotide
gccuauaaucuccaaagaa

SEQ ID NO: 1375 - RNA, 19 nt, Artificial Sequence
  Description of Artificial Sequence: Synthetic oligonucleotide
ccuauaaucuccaaagaaa

SEQ ID NO: 1376 - RNA, 19 nt, Artificial Sequence
  Description of Artificial Sequence: Synthetic oligonucleotide
cuauaaucuccaaagaaag

SEQ ID NO: 1377 - RNA, 19 nt, Artificial Sequence
  Description of Artificial Sequence: Synthetic oligonucleotide
uauaaucuccaaagaaaga

SEQ ID NO: 1378 - RNA, 19 nt, Artificial Sequence
  Description of Artificial Sequence: Synthetic oligonucleotide
auaaucuccaaagaaagaa

SEQ ID NO: 1379 - RNA, 19 nt, Artificial Sequence
  Description of Artificial Sequence: Synthetic oligonucleotide
uaaucuccaaagaaagaau

SEQ ID NO: 1380 - RNA, 19 nt, Artificial Sequence
  Description of Artificial Sequence: Synthetic oligonucleotide
aaucuccaaagaaagaaua

SEQ ID NO: 1381 - RNA, 19 nt, Artificial Sequence
  Description of Artificial Sequence: Synthetic oligonucleotide
aucuccaaagaaagaauaa

SEQ ID NO: 1382 - RNA, 19 nt, Artificial Sequence
  Description of Artificial Sequence: Synthetic oligonucleotide
ucuccaaagaaagaauaag

SEQ ID NO: 1383 - RNA, 19 nt, Artificial Sequence
  Description of Artificial Sequence: Synthetic oligonucleotide
cuccaaagaaagaauaagu

SEQ ID NO: 1384 - RNA, 19 nt, Artificial Sequence
  Description of Artificial Sequence: Synthetic oligonucleotide
uccaaagaaagaauaaguc

SEQ ID NO: 1385 - RNA, 19 nt, Artificial Sequence
  Description of Artificial Sequence: Synthetic oligonucleotide
ccaaagaaagaauaagucu

SEQ ID NO: 1386 - RNA, 19 nt, Artificial Sequence
  Description of Artificial Sequence: Synthetic oligonucleotide
caaagaaagaauaagucuc

SEQ ID NO: 1387 - RNA, 19 nt, Artificial Sequence
  Description of Artificial Sequence: Synthetic oligonucleotide
aaagaaagaauaagucucc

SEQ ID NO: 1388 - RNA, 19 nt, Artificial Sequence
  Description of Artificial Sequence: Synthetic oligonucleotide
aagaaagaauaagucucca

SEQ ID NO: 1389 - RNA, 19 nt, Artificial Sequence
  Description of Artificial Sequence: Synthetic oligonucleotide
agaaagaauaagucuccaa

SEQ ID NO: 1390 - RNA, 19 nt, Artificial Sequence
  Description of Artificial Sequence: Synthetic oligonucleotide
gaaagaauaagucuccaag

SEQ ID NO: 1391 - RNA, 19 nt, Artificial Sequence
  Description of Artificial Sequence: Synthetic oligonucleotide
aaagaauaagucuccaagg

SEQ ID NO: 1392 - RNA, 19 nt, Artificial Sequence
  Description of Artificial Sequence: Synthetic oligonucleotide
aagaauaagucuccaagga

SEQ ID NO: 1393 - RNA, 19 nt, Artificial Sequence
  Description of Artificial Sequence: Synthetic oligonucleotide
agaauaagucuccaaggag

SEQ ID NO: 1394 - RNA, 19 nt, Artificial Sequence
  Description of Artificial Sequence: Synthetic oligonucleotide
gaauaagucuccaaggagc

SEQ ID NO: 1395 - RNA, 19 nt, Artificial Sequence
  Description of Artificial Sequence: Synthetic oligonucleotide
aauaagucuccaaggagca

SEQ ID NO: 1396 - RNA, 19 nt, Artificial Sequence
  Description of Artificial Sequence: Synthetic oligonucleotide
auaagucuccaaggagcac

SEQ ID NO: 1397 - RNA, 19 nt, Artificial Sequence
  Description of Artificial Sequence: Synthetic oligonucleotide
uaagucuccaaggagcaca

SEQ ID NO: 1398 - RNA, 19 nt, Artificial Sequence
  Description of Artificial Sequence: Synthetic oligonucleotide
aagucuccaaggagcacaa

SEQ ID NO: 1399 - RNA, 19 nt, Artificial Sequence
  Description of Artificial Sequence: Synthetic oligonucleotide
agucuccaaggagcacaaa

SEQ ID NO: 1400 - RNA, 19 nt, Artificial Sequence
  Description of Artificial Sequence: Synthetic oligonucleotide
gucuccaaggagcacaaaa

SEQ ID NO: 1401 - RNA, 19 nt, Artificial Sequence
  Description of Artificial Sequence: Synthetic oligonucleotide
ucuccaaggagcacaaaaa

SEQ ID NO: 1402 - RNA, 19 nt, Artificial Sequence
  Description of Artificial Sequence: Synthetic oligonucleotide
cuccaaggagcacaaaaaa

SEQ ID NO: 1403 - RNA, 19 nt, Artificial Sequence
  Description of Artificial Sequence: Synthetic oligonucleotide
uccaaggagcacaaaaaaa

SEQ ID NO: 1404 - RNA, 19 nt, Artificial Sequence
  Description of Artificial Sequence: Synthetic oligonucleotide
ccaaggagcacaaaaaaau

SEQ ID NO: 1405 - RNA, 19 nt, Artificial Sequence
  Description of Artificial Sequence: Synthetic oligonucleotide
caaggagcacaaaaaaauc

SEQ ID NO: 1406 - RNA, 19 nt, Artificial Sequence
  Description of Artificial Sequence: Synthetic oligonucleotide
aaggagcacaaaaaaauca

SEQ ID NO: 1407 - RNA, 19 nt, Artificial Sequence
  Description of Artificial Sequence: Synthetic oligonucleotide
aggagcacaaaaaaaucau

SEQ ID NO: 1408 - RNA, 19 nt, Artificial Sequence
  Description of Artificial Sequence: Synthetic oligonucleotide
ggagcacaaaaaaaucaua

SEQ ID NO: 1409 - RNA, 19 nt, Artificial Sequence
  Description of Artificial Sequence: Synthetic oligonucleotide
gagcacaaaaaaaucauau

SEQ ID NO: 1410 - RNA, 19 nt, Artificial Sequence
  Description of Artificial Sequence: Synthetic oligonucleotide
agcacaaaaaaaucauaug

SEQ ID NO: 1411 - RNA, 19 nt, Artificial Sequence
  Description of Artificial Sequence: Synthetic oligonucleotide
gcacaaaaaaaucauaugu

SEQ ID NO: 1412 - RNA, 19 nt, Artificial Sequence
  Description of Artificial Sequence: Synthetic oligonucleotide
cacaaaaaaaucauaugua

SEQ ID NO: 1413 - RNA, 19 nt, Artificial Sequence
  Description of Artificial Sequence: Synthetic oligonucleotide
acaaaaaaaucauauguac

SEQ ID NO: 1414 - RNA, 19 nt, Artificial Sequence
  Description of Artificial Sequence: Synthetic oligonucleotide
caaaaaaaucauauguacc

SEQ ID NO: 1415 - RNA, 19 nt, Artificial Sequence
  Description of Artificial Sequence: Synthetic oligonucleotide
aaaaaaaucauauguacca

SEQ ID NO: 1416 - RNA, 19 nt, Artificial Sequence
  Description of Artificial Sequence: Synthetic oligonucleotide
aaaaaaucauauguaccaa

SEQ ID NO: 1417 - RNA, 19 nt, Artificial Sequence
  Description of Artificial Sequence: Synthetic oligonucleotide
aaaaaucauauguaccaag

SEQ ID NO: 1418 - RNA, 19 nt, Artificial Sequence
  Description of Artificial Sequence: Synthetic oligonucleotide
aaaaucauauguaccaagg

SEQ ID NO: 1419 - RNA, 19 nt, Artificial Sequence
  Description of Artificial Sequence: Synthetic oligonucleotide
aaaucauauguaccaagga

SEQ ID NO: 1420 - RNA, 19 nt, Artificial Sequence
  Description of Artificial Sequence: Synthetic oligonucleotide
aaucauauguaccaaggau

SEQ ID NO: 1421 - RNA, 19 nt, Artificial Sequence
  Description of Artificial Sequence: Synthetic oligonucleotide
aucauauguaccaaggaug

SEQ ID NO: 1422 - RNA, 19 nt, Artificial Sequence
  Description of Artificial Sequence: Synthetic oligonucleotide
ucauauguaccaaggaugu

SEQ ID NO: 1423 - RNA, 19 nt, Artificial Sequence
  Description of Artificial Sequence: Synthetic oligonucleotide
cauauguaccaaggauguu

SEQ ID NO: 1424 - RNA, 19 nt, Artificial Sequence
  Description of Artificial Sequence: Synthetic oligonucleotide
auauguaccaaggauguua

SEQ ID NO: 1425 - RNA, 19 nt, Artificial Sequence
  Description of Artificial Sequence: Synthetic oligonucleotide
uauguaccaaggauguuac

SEQ ID NO: 1426 - RNA, 19 nt, Artificial Sequence
  Description of Artificial Sequence: Synthetic oligonucleotide
auguaccaaggauguuaca

SEQ ID NO: 1427 - RNA, 19 nt, Artificial Sequence
  Description of Artificial Sequence: Synthetic oligonucleotide
uguaccaaggauguuacag

SEQ ID NO: 1428 - RNA, 19 nt, Artificial Sequence
  Description of Artificial Sequence: Synthetic oligonucleotide
guaccaaggauguuacagu

SEQ ID NO: 1429 - RNA, 19 nt, Artificial Sequence
  Description of Artificial Sequence: Synthetic oligonucleotide
uaccaaggauguuacagua

SEQ ID NO: 1430 - RNA, 19 nt, Artificial Sequence
  Description of Artificial Sequence: Synthetic oligonucleotide
accaaggauguuacaguaa

SEQ ID NO: 1431 - RNA, 19 nt, Artificial Sequence
  Description of Artificial Sequence: Synthetic oligonucleotide
ccaaggauguuacaguaaa

SEQ ID NO: 1432 - RNA, 19 nt, Artificial Sequence
  Description of Artificial Sequence: Synthetic oligonucleotide
caaggauguuacaguaaac

SEQ ID NO: 1433 - RNA, 19 nt, Artificial Sequence
  Description of Artificial Sequence: Synthetic oligonucleotide
aaggauguuacaguaaaca

SEQ ID NO: 1434 - RNA, 19 nt, Artificial Sequence
  Description of Artificial Sequence: Synthetic oligonucleotide
aggauguuacaguaaacag

SEQ ID NO: 1435 - RNA, 19 nt, Artificial Sequence
  Description of Artificial Sequence: Synthetic oligonucleotide
ggauguuacaguaaacagg

SEQ ID NO: 1436 - RNA, 19 nt, Artificial Sequence
  Description of Artificial Sequence: Synthetic oligonucleotide
gauguuacaguaaacagga

SEQ ID NO: 1437 - RNA, 19 nt, Artificial Sequence
  Description of Artificial Sequence: Synthetic oligonucleotide
auguuacaguaaacaggau

SEQ ID NO: 1438 - RNA, 19 nt, Artificial Sequence
  Description of Artificial Sequence: Synthetic oligonucleotide
uguuacaguaaacaggaug

SEQ ID NO: 1439 - RNA, 19 nt, Artificial Sequence
  Description of Artificial Sequence: Synthetic oligonucleotide
guuacaguaaacaggauga

SEQ ID NO: 1440 - RNA, 19 nt, Artificial Sequence
  Description of Artificial Sequence: Synthetic oligonucleotide
uuacaguaaacaggaugaa

SEQ ID NO: 1441 - RNA, 19 nt, Artificial Sequence
  Description of Artificial Sequence: Synthetic oligonucleotide
uacaguaaacaggaugaac

SEQ ID NO: 1442 - RNA, 19 nt, Artificial Sequence
  Description of Artificial Sequence: Synthetic oligonucleotide
acaguaaacaggaugaacu

SEQ ID NO: 1443 - RNA, 19 nt, Artificial Sequence
  Description of Artificial Sequence: Synthetic oligonucleotide
caguaaacaggaugaacua

SEQ ID NO: 1444 - RNA, 19 nt, Artificial Sequence
  Description of Artificial Sequence: Synthetic oligonucleotide
aguaaacaggaugaacuau

SEQ ID NO: 1445 - RNA, 19 nt, Artificial Sequence
  Description of Artificial Sequence: Synthetic oligonucleotide
guaaacaggaugaacuauu

SEQ ID NO: 1446 - RNA, 19 nt, Artificial Sequence
  Description of Artificial Sequence: Synthetic oligonucleotide
uaaacaggaugaacuauuu

SEQ ID NO: 1447 - RNA, 19 nt, Artificial Sequence
  Description of Artificial Sequence: Synthetic oligonucleotide
aaacaggaugaacuauuua

SEQ ID NO: 1448 - RNA, 19 nt, Artificial Sequence
  Description of Artificial Sequence: Synthetic oligonucleotide
aacaggaugaacuauuuaa

SEQ ID NO: 1449 - RNA, 19 nt, Artificial Sequence
  Description of Artificial Sequence: Synthetic oligonucleotide
acaggaugaacuauuuaaa

SEQ ID NO: 1450 - RNA, 19 nt, Artificial Sequence
  Description of Artificial Sequence: Synthetic oligonucleotide
caggaugaacuauuuaaac

SEQ ID NO: 1451 - RNA, 19 nt, Artificial Sequence
  Description of Artificial Sequence: Synthetic oligonucleotide
aggaugaacuauuuaaacc

SEQ ID NO: 1452 - RNA, 19 nt, Artificial Sequence
  Description of Artificial Sequence: Synthetic oligonucleotide
ggaugaacuauuuaaaccc

SEQ ID NO: 1453 - RNA, 19 nt, Artificial Sequence
  Description of Artificial Sequence: Synthetic oligonucleotide
gaugaacuauuuaaaccca

SEQ ID NO: 1454 - RNA, 19 nt, Artificial Sequence
  Description of Artificial Sequence: Synthetic oligonucleotide
augaacuauuuaaacccac

SEQ ID NO: 1455 - RNA, 19 nt, Artificial Sequence
  Description of Artificial Sequence: Synthetic oligonucleotide
ugaacuauuuaaacccacu

SEQ ID NO: 1456 - RNA, 19 nt, Artificial Sequence
  Description of Artificial Sequence: Synthetic oligonucleotide
gaacuauuuaaacccacug

SEQ ID NO: 1457 - RNA, 19 nt, Artificial Sequence
  Description of Artificial Sequence: Synthetic oligonucleotide
aacuauuuaaacccacugg

SEQ ID NO: 1458 - RNA, 19 nt, Artificial Sequence
  Description of Artificial Sequence: Synthetic oligonucleotide
acuauuuaaacccacuggg

SEQ ID NO: 1459 - RNA, 19 nt, Artificial Sequence
  Description of Artificial Sequence: Synthetic oligonucleotide
cuauuuaaacccacugggu

SEQ ID NO: 1460 - RNA, 19 nt, Artificial Sequence
  Description of Artificial Sequence: Synthetic oligonucleotide
uauuuaaacccacuggguc

SEQ ID NO: 1461 - RNA, 19 nt, Artificial Sequence
  Description of Artificial Sequence: Synthetic oligonucleotide
auuuaaacccacugggucc

SEQ ID NO: 1462 - RNA, 19 nt, Artificial Sequence
  Description of Artificial Sequence: Synthetic oligonucleotide
uuuaaacccacuggguccu

SEQ ID NO: 1463 - RNA, 19 nt, Artificial Sequence
  Description of Artificial Sequence: Synthetic oligonucleotide
uuaaacccacuggguccug

SEQ ID NO: 1464 - RNA, 19 nt, Artificial Sequence
  Description of Artificial Sequence: Synthetic oligonucleotide
uaaacccacuggguccugc

SEQ ID NO: 1465 - RNA, 19 nt, Artificial Sequence
  Description of Artificial Sequence: Synthetic oligonucleotide
aaacccacuggguccugcc

SEQ ID NO: 1466 - RNA, 19 nt, Artificial Sequence
  Description of Artificial Sequence: Synthetic oligonucleotide
aacccacuggguccugcca

SEQ ID NO: 1467 - RNA, 19 nt, Artificial Sequence
  Description of Artificial Sequence: Synthetic oligonucleotide
acccacuggguccugccac

SEQ ID NO: 1468 - RNA, 19 nt, Artificial Sequence
  Description of Artificial Sequence: Synthetic oligonucleotide
cccacuggguccugccaca

SEQ ID NO: 1469 - RNA, 19 nt, Artificial Sequence
  Description of Artificial Sequence: Synthetic oligonucleotide
ccacuggguccugccacau

SEQ ID NO: 1470 - RNA, 19 nt, Artificial Sequence
  Description of Artificial Sequence: Synthetic oligonucleotide
cacuggguccugccacauc

SEQ ID NO: 1471 - RNA, 19 nt, Artificial Sequence
  Description of Artificial Sequence: Synthetic oligonucleotide
acuggguccugccacaucc

SEQ ID NO: 1472 - RNA, 19 nt, Artificial Sequence
  Description of Artificial Sequence: Synthetic oligonucleotide
cuggguccugccacauccu

SEQ ID NO: 1473 - RNA, 19 nt, Artificial Sequence
  Description of Artificial Sequence: Synthetic oligonucleotide
uggguccugccacauccuu

SEQ ID NO: 1474 - RNA, 19 nt, Artificial Sequence
  Description of Artificial Sequence: Synthetic oligonucleotide
ggguccugccacauccuuc

SEQ ID NO: 1475 - RNA, 19 nt, Artificial Sequence
  Description of Artificial Sequence: Synthetic oligonucleotide
gguccugccacauccuucu

SEQ ID NO: 1476 - RNA, 19 nt, Artificial Sequence
  Description of Artificial Sequence: Synthetic oligonucleotide
guccugccacauccuucuc

SEQ ID NO: 1477 - RNA, 19 nt, Artificial Sequence
  Description of Artificial Sequence: Synthetic oligonucleotide
uccugccacauccuucuca

SEQ ID NO: 1478 - RNA, 19 nt, Artificial Sequence
  Description of Artificial Sequence: Synthetic oligonucleotide
ccugccacauccuucucaa

SEQ ID NO: 1479 - RNA, 19 nt, Artificial Sequence
  Description of Artificial Sequence: Synthetic oligonucleotide
cugccacauccuucucaag

SEQ ID NO: 1480 - RNA, 19 nt, Artificial Sequence
  Description of Artificial Sequence: Synthetic oligonucleotide
ugccacauccuucucaagg

SEQ ID NO: 1481 - RNA, 19 nt, Artificial Sequence
  Description of Artificial Sequence: Synthetic oligonucleotide
gccacauccuucucaaggu

SEQ ID NO: 1482 - RNA, 19 nt, Artificial Sequence
  Description of Artificial Sequence: Synthetic oligonucleotide
ccacauccuucucaaggug

SEQ ID NO: 1483 - RNA, 19 nt, Artificial Sequence
  Description of Artificial Sequence: Synthetic oligonucleotide
cacauccuucucaaggugg

SEQ ID NO: 1484 - RNA, 19 nt, Artificial Sequence
  Description of Artificial Sequence: Synthetic oligonucleotide
acauccuucucaagguggu

SEQ ID NO: 1485 - RNA, 19 nt, Artificial Sequence
  Description of Artificial Sequence: Synthetic oligonucleotide
cauccuucucaagguggua

SEQ ID NO: 1486 - RNA, 19 nt, Artificial Sequence
  Description of Artificial Sequence: Synthetic oligonucleotide
auccuucucaaggugguag

SEQ ID NO: 1487 - RNA, 19 nt, Artificial Sequence
  Description of Artificial Sequence: Synthetic oligonucleotide
uccuucucaaggugguaga

SEQ ID NO: 1488 - RNA, 19 nt, Artificial Sequence
  Description of Artificial Sequence: Synthetic oligonucleotide
ccuucucaaggugguagac

SEQ ID NO: 1489 - RNA, 19 nt, Artificial Sequence
  Description of Artificial Sequence: Synthetic oligonucleotide
cuucucaaggugguagacu

SEQ ID NO: 1490 - RNA, 19 nt, Artificial Sequence
  Description of Artificial Sequence: Synthetic oligonucleotide
uucucaaggugguagacug

SEQ ID NO: 1491 - RNA, 19 nt, Artificial Sequence
  Description of Artificial Sequence: Synthetic oligonucleotide
ucucaaggugguagacuga

SEQ ID NO: 1492 - RNA, 19 nt, Artificial Sequence
  Description of Artificial Sequence: Synthetic oligonucleotide
cucaaggugguagacugag

SEQ ID NO: 1493 - RNA, 19 nt, Artificial Sequence
  Description of Artificial Sequence: Synthetic oligonucleotide
ucaaggugguagacugagu

SEQ ID NO: 1494 - RNA, 19 nt, Artificial Sequence
  Description of Artificial Sequence: Synthetic oligonucleotide
caaggugguagacugagug

SEQ ID NO: 1495 - RNA, 19 nt, Artificial Sequence
  Description of Artificial Sequence: Synthetic oligonucleotide
aaggugguagacugagugg

SEQ ID NO: 1496 - RNA, 19 nt, Artificial Sequence
  Description of Artificial Sequence: Synthetic oligonucleotide
aggugguagacugaguggg

SEQ ID NO: 1497 - RNA, 19 nt, Artificial Sequence
  Description of Artificial Sequence: Synthetic oligonucleotide
ggugguagacugagugggg

SEQ ID NO: 1498 - RNA, 19 nt, Artificial Sequence
  Description of Artificial Sequence: Synthetic oligonucleotide
gugguagacugaguggggu

SEQ ID NO: 1499 - RNA, 19 nt, Artificial Sequence
  Description of Artificial Sequence: Synthetic oligonucleotide
ugguagacugagugggguc

SEQ ID NO: 1500 - RNA, 19 nt, Artificial Sequence
  Description of Artificial Sequence: Synthetic oligonucleotide
gguagacugaguggggucu

SEQ ID NO: 1501 - RNA, 19 nt, Artificial Sequence
  Description of Artificial Sequence: Synthetic oligonucleotide
guagacugaguggggucuc

SEQ ID NO: 1502 - RNA, 19 nt, Artificial Sequence
  Description of Artificial Sequence: Synthetic oligonucleotide
uagacugaguggggucucu

SEQ ID NO: 1503 - RNA, 19 nt, Artificial Sequence
  Description of Artificial Sequence: Synthetic oligonucleotide
agacugaguggggucucuc

SEQ ID NO: 1504 - RNA, 19 nt, Artificial Sequence
  Description of Artificial Sequence: Synthetic oligonucleotide
gacugaguggggucucucu

SEQ ID NO: 1505 - RNA, 19 nt, Artificial Sequence
  Description of Artificial Sequence: Synthetic oligonucleotide
acugaguggggucucucug

SEQ ID NO: 1506 - RNA, 19 nt, Artificial Sequence
  Description of Artificial Sequence: Synthetic oligonucleotide
cugaguggggucucucugc

SEQ ID NO: 1507 - RNA, 19 nt, Artificial Sequence
  Description of Artificial Sequence: Synthetic oligonucleotide
ugaguggggucucucugcc

SEQ ID NO: 1508 - RNA, 19 nt, Artificial Sequence
  Description of Artificial Sequence: Synthetic oligonucleotide
gaguggggucucucugccc

SEQ ID NO: 1509 - RNA, 19 nt, Artificial Sequence
  Description of Artificial Sequence: Synthetic oligonucleotide
aguggggucucucugccca

SEQ ID NO: 1510 - RNA, 19 nt, Artificial Sequence
  Description of Artificial Sequence: Synthetic oligonucleotide
guggggucucucugcccaa

SEQ ID NO: 1511 - RNA, 19 nt, Artificial Sequence
  Description of Artificial Sequence: Synthetic oligonucleotide
uggggucucucugcccaag

SEQ ID NO: 1512 - RNA, 19 nt, Artificial Sequence
  Description of Artificial Sequence: Synthetic oligonucleotide
ggggucucucugcccaaga

SEQ ID NO: 1513 - RNA, 19 nt, Artificial Sequence
  Description of Artificial Sequence: Synthetic oligonucleotide
gggucucucugcccaagau

SEQ ID NO: 1514 - RNA, 19 nt, Artificial Sequence
  Description of Artificial Sequence: Synthetic oligonucleotide
ggucucucugcccaagauc

SEQ ID NO: 1515 - RNA, 19 nt, Artificial Sequence
  Description of Artificial Sequence: Synthetic oligonucleotide
gucucucugcccaagaucc

SEQ ID NO: 1516 - RNA, 19 nt, Artificial Sequence
  Description of Artificial Sequence: Synthetic oligonucleotide
ucucucugcccaagauccc

SEQ ID NO: 1517 - RNA, 19 nt, Artificial Sequence
  Description of Artificial Sequence: Synthetic oligonucleotide
cucucugcccaagaucccu

SEQ ID NO: 1518 - RNA, 19 nt, Artificial Sequence
  Description of Artificial Sequence: Synthetic oligonucleotide
ucucugcccaagaucccug

SEQ ID NO: 1519 - RNA, 19 nt, Artificial Sequence
  Description of Artificial Sequence: Synthetic oligonucleotide
cucugcccaagaucccuga

SEQ ID NO: 1520 - RNA, 19 nt, Artificial Sequence
  Description of Artificial Sequence: Synthetic oligonucleotide
ucugcccaagaucccugac

SEQ ID NO: 1521 - RNA, 19 nt, Artificial Sequence
  Description of Artificial Sequence: Synthetic oligonucleotide
cugcccaagaucccugaca

SEQ ID NO: 1522 - RNA, 19 nt, Artificial Sequence
  Description of Artificial Sequence: Synthetic oligonucleotide
ugcccaagaucccugacau

SEQ ID NO: 1523 - RNA, 19 nt, Artificial Sequence
  Description of Artificial Sequence: Synthetic oligonucleotide
gcccaagaucccugacaua

SEQ ID NO: 1524 - RNA, 19 nt, Artificial Sequence
  Description of Artificial Sequence: Synthetic oligonucleotide
cccaagaucccugacauag

SEQ ID NO: 1525 - RNA, 19 nt, Artificial Sequence
  Description of Artificial Sequence: Synthetic oligonucleotide
ccaagaucccugacauagc

SEQ ID NO: 1526 - RNA, 19 nt, Artificial Sequence
  Description of Artificial Sequence: Synthetic oligonucleotide
caagaucccugacauagca

SEQ ID NO: 1527 - RNA, 19 nt, Artificial Sequence
  Description of Artificial Sequence: Synthetic oligonucleotide
aagaucccugacauagcag

SEQ ID NO: 1528 - RNA, 19 nt, Artificial Sequence
  Description of Artificial Sequence: Synthetic oligonucleotide
agaucccugacauagcagu

SEQ ID NO: 1529 - RNA, 19 nt, Artificial Sequence
  Description of Artificial Sequence: Synthetic oligonucleotide
gaucccugacauagcagua

SEQ ID NO: 1530 - RNA, 19 nt, Artificial Sequence
  Description of Artificial Sequence: Synthetic oligonucleotide
aucccugacauagcaguag

SEQ ID NO: 1531 - RNA, 19 nt, Artificial Sequence
  Description of Artificial Sequence: Synthetic oligonucleotide
ucccugacauagcaguagc

SEQ ID NO: 1532 - RNA, 19 nt, Artificial Sequence
  Description of Artificial Sequence: Synthetic oligonucleotide
cccugacauagcaguagcu

SEQ ID NO: 1533 - RNA, 19 nt, Artificial Sequence
  Description of Artificial Sequence: Synthetic oligonucleotide
ccugacauagcaguagcuu

SEQ ID NO: 1534 - RNA, 19 nt, Artificial Sequence
  Description of Artificial Sequence: Synthetic oligonucleotide
cugacauagcaguagcuug

SEQ ID NO: 1535 - RNA, 19 nt, Artificial Sequence
  Description of Artificial Sequence: Synthetic oligonucleotide
ugacauagcaguagcuugu

SEQ ID NO: 1536 - RNA, 19 nt, Artificial Sequence
  Description of Artificial Sequence: Synthetic oligonucleotide
gacauagcaguagcuuguc

SEQ ID NO: 1537 - RNA, 19 nt, Artificial Sequence
  Description of Artificial Sequence: Synthetic oligonucleotide
acauagcaguagcuugucu

SEQ ID NO: 1538 - RNA, 19 nt, Artificial Sequence
  Description of Artificial Sequence: Synthetic oligonucleotide
cauagcaguagcuugucuu

SEQ ID NO: 1539 - RNA, 19 nt, Artificial Sequence
  Description of Artificial Sequence: Synthetic oligonucleotide
auagcaguagcuugucuuu

SEQ ID NO: 1540 - RNA, 19 nt, Artificial Sequence
  Description of Artificial Sequence: Synthetic oligonucleotide
uagcaguagcuugucuuuu

SEQ ID NO: 1541 - RNA, 19 nt, Artificial Sequence
  Description of Artificial Sequence: Synthetic oligonucleotide
agcaguagcuugucuuuuc

SEQ ID NO: 1542 - RNA, 19 nt, Artificial Sequence
  Description of Artificial Sequence: Synthetic oligonucleotide
gcaguagcuugucuuuucc

SEQ ID NO: 1543 - RNA, 19 nt, Artificial Sequence
  Description of Artificial Sequence: Synthetic oligonucleotide
caguagcuugucuuuucca

SEQ ID NO: 1544 - RNA, 19 nt, Artificial Sequence
  Description of Artificial Sequence: Synthetic oligonucleotide
aguagcuugucuuuuccac

SEQ ID NO: 1545 - RNA, 19 nt, Artificial Sequence
  Description of Artificial Sequence: Synthetic oligonucleotide
guagcuugucuuuuccaca

SEQ ID NO: 1546 - RNA, 19 nt, Artificial Sequence
  Description of Artificial Sequence: Synthetic oligonucleotide
uagcuugucuuuuccacau

SEQ ID NO: 1547 - RNA, 19 nt, Artificial Sequence
  Description of Artificial Sequence: Synthetic oligonucleotide
agcuugucuuuuccacaug

SEQ ID NO: 1548 - RNA, 19 nt, Artificial Sequence
  Description of Artificial Sequence: Synthetic oligonucleotide
gcuugucuuuuccacauga

SEQ ID NO: 1549 - RNA, 19 nt, Artificial Sequence
  Description of Artificial Sequence: Synthetic oligonucleotide
cuugucuuuuccacaugau

SEQ ID NO: 1550 - RNA, 19 nt, Artificial Sequence
  Description of Artificial Sequence: Synthetic oligonucleotide
uugucuuuuccacaugauu

SEQ ID NO: 1551 - RNA, 19 nt, Artificial Sequence
  Description of Artificial Sequence: Synthetic oligonucleotide
ugucuuuuccacaugauuu

SEQ ID NO: 1552 - RNA, 19 nt, Artificial Sequence
  Description of Artificial Sequence: Synthetic oligonucleotide
gucuuuuccacaugauuug

SEQ ID NO: 1553 - RNA, 19 nt, Artificial Sequence
  Description of Artificial Sequence: Synthetic oligonucleotide
ucuuuuccacaugauuugu

SEQ ID NO: 1554 - RNA, 19 nt, Artificial Sequence
  Description of Artificial Sequence: Synthetic oligonucleotide
cuuuuccacaugauuuguc

SEQ ID NO: 1555 - RNA, 19 nt, Artificial Sequence
  Description of Artificial Sequence: Synthetic oligonucleotide
uuuuccacaugauuugucu

SEQ ID NO: 1556 - RNA, 19 nt, Artificial Sequence
  Description of Artificial Sequence: Synthetic oligonucleotide
uuuccacaugauuugucug

SEQ ID NO: 1557 - RNA, 19 nt, Artificial Sequence
  Description of Artificial Sequence: Synthetic oligonucleotide
uuccacaugauuugucugu

SEQ ID NO: 1558 - RNA, 19 nt, Artificial Sequence
  Description of Artificial Sequence: Synthetic oligonucleotide
uccacaugauuugucugug

SEQ ID NO: 1559 - RNA, 19 nt, Artificial Sequence
  Description of Artificial Sequence: Synthetic oligonucleotide
ccacaugauuugucuguga

SEQ ID NO: 1560 - RNA, 19 nt, Artificial Sequence
  Description of Artificial Sequence: Synthetic oligonucleotide
cacaugauuugucugugaa

SEQ ID NO: 1561 - RNA, 19 nt, Artificial Sequence
  Description of Artificial Sequence: Synthetic oligonucleotide
acaugauuugucugugaaa

SEQ ID NO: 1562 - RNA, 19 nt, Artificial Sequence
  Description of Artificial Sequence: Synthetic oligonucleotide
caugauuugucugugaaag

SEQ ID NO: 1563 - RNA, 19 nt, Artificial Sequence
  Description of Artificial Sequence: Synthetic oligonucleotide
augauuugucugugaaaga

SEQ ID NO: 1564 - RNA, 19 nt, Artificial Sequence
  Description of Artificial Sequence: Synthetic oligonucleotide
ugauuugucugugaaagaa

SEQ ID NO: 1565 - RNA, 19 nt, Artificial Sequence
  Description of Artificial Sequence: Synthetic oligonucleotide
gauuugucugugaaagaaa

SEQ ID NO: 1566 - RNA, 19 nt, Artificial Sequence
  Description of Artificial Sequence: Synthetic oligonucleotide
auuugucugugaaagaaaa

SEQ ID NO: 1567 - RNA, 19 nt, Artificial Sequence
  Description of Artificial Sequence: Synthetic oligonucleotide
uuugucugugaaagaaaau

SEQ ID NO: 1568 - RNA, 19 nt, Artificial Sequence
  Description of Artificial Sequence: Synthetic oligonucleotide
uugucugugaaagaaaaua

SEQ ID NO: 1569 - RNA, 19 nt, Artificial Sequence
  Description of Artificial Sequence: Synthetic oligonucleotide
ugucugugaaagaaaauaa

SEQ ID NO: 1570 - RNA, 19 nt, Artificial Sequence
  Description of Artificial Sequence: Synthetic oligonucleotide
gucugugaaagaaaauaau

SEQ ID NO: 1571 - RNA, 19 nt, Artificial Sequence
  Description of Artificial Sequence: Synthetic oligonucleotide
ucugugaaagaaaauaauu

SEQ ID NO: 1572 - RNA, 19 nt, Artificial Sequence
  Description of Artificial Sequence: Synthetic oligonucleotide
cugugaaagaaaauaauuu

SEQ ID NO: 1573 - RNA, 19 nt, Artificial Sequence
  Description of Artificial Sequence: Synthetic oligonucleotide
ugugaaagaaaauaauuuu

SEQ ID NO: 1574 - RNA, 19 nt, Artificial Sequence
  Description of Artificial Sequence: Synthetic oligonucleotide
gugaaagaaaauaauuuug

SEQ ID NO: 1575 - RNA, 19 nt, Artificial Sequence
  Description of Artificial Sequence: Synthetic oligonucleotide
ugaaagaaaauaauuuuga

SEQ ID NO: 1576 - RNA, 19 nt, Artificial Sequence
  Description of Artificial Sequence: Synthetic oligonucleotide
gaaagaaaauaauuuugag

SEQ ID NO: 1577 - RNA, 19 nt, Artificial Sequence
  Description of Artificial Sequence: Synthetic oligonucleotide
aaagaaaauaauuuugaga

SEQ ID NO: 1578 - RNA, 19 nt, Artificial Sequence
  Description of Artificial Sequence: Synthetic oligonucleotide
aagaaaauaauuuugagau

SEQ ID NO: 1579 - RNA, 19 nt, Artificial Sequence
  Description of Artificial Sequence: Synthetic oligonucleotide
agaaaauaauuuugagauc

SEQ ID NO: 1580 - RNA, 19 nt, Artificial Sequence
  Description of Artificial Sequence: Synthetic oligonucleotide
gaaaauaauuuugagaucg

SEQ ID NO: 1581 - RNA, 19 nt, Artificial Sequence
  Description of Artificial Sequence: Synthetic oligonucleotide
aaaauaauuuugagaucgu

SEQ ID NO: 1582 - RNA, 19 nt, Artificial Sequence
  Description of Artificial Sequence: Synthetic oligonucleotide
aaauaauuuugagaucguu

SEQ ID NO: 1583 - RNA, 19 nt, Artificial Sequence
  Description of Artificial Sequence: Synthetic oligonucleotide
aauaauuuugagaucguuu

SEQ ID NO: 1584 - RNA, 19 nt, Artificial Sequence
  Description of Artificial Sequence: Synthetic oligonucleotide
auaauuuugagaucguuuu

SEQ ID NO: 1585 - RNA, 19 nt, Artificial Sequence
  Description of Artificial Sequence: Synthetic oligonucleotide
uaauuuugagaucguuuua

SEQ ID NO: 1586 - RNA, 19 nt, Artificial Sequence
  Description of Artificial Sequence: Synthetic oligonucleotide
aauuuugagaucguuuuau

SEQ ID NO: 1587 - RNA, 19 nt, Artificial Sequence
  Description of Artificial Sequence: Synthetic oligonucleotide
auuuugagaucguuuuauc

SEQ ID NO: 1588 - RNA, 19 nt, Artificial Sequence
  Description of Artificial Sequence: Synthetic oligonucleotide
uuuugagaucguuuuaucu

SEQ ID NO: 1589 - RNA, 19 nt, Artificial Sequence
  Description of Artificial Sequence: Synthetic oligonucleotide
uuugagaucguuuuaucua

SEQ ID NO: 1590 - RNA, 19 nt, Artificial Sequence
  Description of Artificial Sequence: Synthetic oligonucleotide
uugagaucguuuuaucuau

SEQ ID NO: 1591 - RNA, 19 nt, Artificial Sequence
  Description of Artificial Sequence: Synthetic oligonucleotide
ugagaucguuuuaucuauu

SEQ ID NO: 1592 - RNA, 19 nt, Artificial Sequence
  Description of Artificial Sequence: Synthetic oligonucleotide
gagaucguuuuaucuauuu

SEQ ID NO: 1593 - RNA, 19 nt, Artificial Sequence
  Description of Artificial Sequence: Synthetic oligonucleotide
agaucguuuuaucuauuuu

SEQ ID NO: 1594 - RNA, 19 nt, Artificial Sequence
  Description of Artificial Sequence: Synthetic oligonucleotide
gaucguuuuaucuauuuuc

SEQ ID NO: 1595 - RNA, 19 nt, Artificial Sequence
  Description of Artificial Sequence: Synthetic oligonucleotide
aucguuuuaucuauuuucu

SEQ ID NO: 1596 - RNA, 19 nt, Artificial Sequence
  Description of Artificial Sequence: Synthetic oligonucleotide
ucguuuuaucuauuuucuc

SEQ ID NO: 1597 - RNA, 19 nt, Artificial Sequence
  Description of Artificial Sequence: Synthetic oligonucleotide
cguuuuaucuauuuucucu

SEQ ID NO: 1598 - RNA, 19 nt, Artificial Sequence
  Description of Artificial Sequence: Synthetic oligonucleotide
guuuuaucuauuuucucua

SEQ ID NO: 1599 - RNA, 19 nt, Artificial Sequence
  Description of Artificial Sequence: Synthetic oligonucleotide
uuuuaucuauuuucucuac

SEQ ID NO: 1600 - RNA, 19 nt, Artificial Sequence
  Description of Artificial Sequence: Synthetic oligonucleotide
uuuaucuauuuucucuacg

SEQ ID NO: 1601 - RNA, 19 nt, Artificial Sequence
  Description of Artificial Sequence: Synthetic oligonucleotide
uuaucuauuuucucuacgg

SEQ ID NO: 1602 - RNA, 19 nt, Artificial Sequence
  Description of Artificial Sequence: Synthetic oligonucleotide
uaucuauuuucucuacggc

SEQ ID NO: 1603 - RNA, 19 nt, Artificial Sequence
  Description of Artificial Sequence: Synthetic oligonucleotide
aucuauuuucucuacggcu

SEQ ID NO: 1604 - RNA, 19 nt, Artificial Sequence
  Description of Artificial Sequence: Synthetic oligonucleotide
ucuauuuucucuacggcuu

SEQ ID NO: 1605 - RNA, 19 nt, Artificial Sequence
  Description of Artificial Sequence: Synthetic oligonucleotide
cuauuuucucuacggcuua

SEQ ID NO: 1606 - RNA, 19 nt, Artificial Sequence
  Description of Artificial Sequence: Synthetic oligonucleotide
uauuuucucuacggcuuag

SEQ ID NO: 1607 - RNA, 19 nt, Artificial Sequence
  Description of Artificial Sequence: Synthetic oligonucleotide
auuuucucuacggcuuagg

SEQ ID NO: 1608 - RNA, 19 nt, Artificial Sequence
  Description of Artificial Sequence: Synthetic oligonucleotide
uuuucucuacggcuuaggc

SEQ ID NO: 1609 - RNA, 19 nt, Artificial Sequence
  Description of Artificial Sequence: Synthetic oligonucleotide
uuucucuacggcuuaggcu

SEQ ID NO: 1610 - RNA, 19 nt, Artificial Sequence
  Description of Artificial Sequence: Synthetic oligonucleotide
uucucuacggcuuaggcua

SEQ ID NO: 1611 - RNA, 19 nt, Artificial Sequence
  Description of Artificial Sequence: Synthetic oligonucleotide
ucucuacggcuuaggcuau

SEQ ID NO: 1612 - RNA, 19 nt, Artificial Sequence
  Description of Artificial Sequence: Synthetic oligonucleotide
cucuacggcuuaggcuaug

SEQ ID NO: 1613 - RNA, 19 nt, Artificial Sequence
  Description of Artificial Sequence: Synthetic oligonucleotide
ucuacggcuuaggcuaugu

SEQ ID NO: 1614 - RNA, 19 nt, Artificial Sequence
  Description of Artificial Sequence: Synthetic oligonucleotide
cuacggcuuaggcuaugug

SEQ ID NO: 1615 - RNA, 19 nt, Artificial Sequence
  Description of Artificial Sequence: Synthetic oligonucleotide
uacggcuuaggcuauguga

SEQ ID NO: 1616 - RNA, 19 nt, Artificial Sequence
  Description of Artificial Sequence: Synthetic oligonucleotide
acggcuuaggcuaugugag

SEQ ID NO: 1617 - RNA, 19 nt, Artificial Sequence
  Description of Artificial Sequence: Synthetic oligonucleotide
cggcuuaggcuaugugagg

SEQ ID NO: 1618 - RNA, 19 nt, Artificial Sequence
  Description of Artificial Sequence: Synthetic oligonucleotide
ggcuuaggcuaugugaggg

SEQ ID NO: 1619 - RNA, 19 nt, Artificial Sequence
  Description of Artificial Sequence: Synthetic oligonucleotide
gcuuaggcuaugugagggc

SEQ ID NO: 1620 - RNA, 19 nt, Artificial Sequence
  Description of Artificial Sequence: Synthetic oligonucleotide
cuuaggcuaugugagggca

SEQ ID NO: 1621 - RNA, 19 nt, Artificial Sequence
  Description of Artificial Sequence: Synthetic oligonucleotide
uuaggcuaugugagggcaa

SEQ ID NO: 1622 - RNA, 19 nt, Artificial Sequence
  Description of Artificial Sequence: Synthetic oligonucleotide
uaggcuaugugagggcaaa

SEQ ID NO: 1623 - RNA, 19 nt, Artificial Sequence
  Description of Artificial Sequence: Synthetic oligonucleotide
aggcuaugugagggcaaaa

SEQ ID NO: 1624 - RNA, 19 nt, Artificial Sequence
  Description of Artificial Sequence: Synthetic oligonucleotide
ggcuaugugagggcaaaac

SEQ ID NO: 1625 - RNA, 19 nt, Artificial Sequence
  Description of Artificial Sequence: Synthetic oligonucleotide
gcuaugugagggcaaaaca

SEQ ID NO: 1626 - RNA, 19 nt, Artificial Sequence
  Description of Artificial Sequence: Synthetic oligonucleotide
cuaugugagggcaaaacac

SEQ ID NO: 1627 - RNA, 19 nt, Artificial Sequence
  Description of Artificial Sequence: Synthetic oligonucleotide
uaugugagggcaaaacaca

SEQ ID NO: 1628 - RNA, 19 nt, Artificial Sequence
  Description of Artificial Sequence: Synthetic oligonucleotide
augugagggcaaaacacaa

SEQ ID NO: 1629 - RNA, 19 nt, Artificial Sequence
  Description of Artificial Sequence: Synthetic oligonucleotide
ugugagggcaaaacacaaa

SEQ ID NO: 1630 - RNA, 19 nt, Artificial Sequence
  Description of Artificial Sequence: Synthetic oligonucleotide
gugagggcaaaacacaaau

SEQ ID NO: 1631 - RNA, 19 nt, Artificial Sequence
  Description of Artificial Sequence: Synthetic oligonucleotide
ugagggcaaaacacaaauc

SEQ ID NO: 1632 - RNA, 19 nt, Artificial Sequence
  Description of Artificial Sequence: Synthetic oligonucleotide
gagggcaaaacacaaaucc

SEQ ID NO: 1633 - RNA, 19 nt, Artificial Sequence
  Description of Artificial Sequence: Synthetic oligonucleotide
agggcaaaacacaaauccc

SEQ ID NO: 1634 - RNA, 19 nt, Artificial Sequence
  Description of Artificial Sequence: Synthetic oligonucleotide
gggcaaaacacaaaucccu

SEQ ID NO: 1635 - RNA, 19 nt, Artificial Sequence
  Description of Artificial Sequence: Synthetic oligonucleotide
ggcaaaacacaaaucccuu

SEQ ID NO: 1636 - RNA, 19 nt, Artificial Sequence
  Description of Artificial Sequence: Synthetic oligonucleotide
gcaaaacacaaaucccuuu

SEQ ID NO: 1637 - RNA, 19 nt, Artificial Sequence
  Description of Artificial Sequence: Synthetic oligonucleotide
caaaacacaaaucccuuug

SEQ ID NO: 1638 - RNA, 19 nt, Artificial Sequence
  Description of Artificial Sequence: Synthetic oligonucleotide
aaaacacaaaucccuuugc

SEQ ID NO: 1639 - RNA, 19 nt, Artificial Sequence
  Description of Artificial Sequence: Synthetic oligonucleotide
aaacacaaaucccuuugcu

SEQ ID NO: 1640 - RNA, 19 nt, Artificial Sequence
  Description of Artificial Sequence: Synthetic oligonucleotide
aacacaaaucccuuugcua

SEQ ID NO: 1641 - RNA, 19 nt, Artificial Sequence
  Description of Artificial Sequence: Synthetic oligonucleotide
acacaaaucccuuugcuaa

SEQ ID NO: 1642 - RNA, 19 nt, Artificial Sequence
  Description of Artificial Sequence: Synthetic oligonucleotide
cacaaaucccuuugcuaaa

SEQ ID NO: 1643 - RNA, 19 nt, Artificial Sequence
  Description of Artificial Sequence: Synthetic oligonucleotide
acaaaucccuuugcuaaaa

SEQ ID NO: 1644 - RNA, 19 nt, Artificial Sequence
  Description of Artificial Sequence: Synthetic oligonucleotide
caaaucccuuugcuaaaaa

SEQ ID NO: 1645 - RNA, 19 nt, Artificial Sequence
  Description of Artificial Sequence: Synthetic oligonucleotide
aaaucccuuugcuaaaaag

SEQ ID NO: 1646 - RNA, 19 nt, Artificial Sequence
  Description of Artificial Sequence: Synthetic oligonucleotide
aaucccuuugcuaaaaaga

SEQ ID NO: 1647 - RNA, 19 nt, Artificial Sequence
  Description of Artificial Sequence: Synthetic oligonucleotide
aucccuuugcuaaaaagaa

SEQ ID NO: 1648 - RNA, 19 nt, Artificial Sequence
  Description of Artificial Sequence: Synthetic oligonucleotide
ucccuuugcuaaaaagaac

SEQ ID NO: 1649 - RNA, 19 nt, Artificial Sequence
  Description of Artificial Sequence: Synthetic oligonucleotide
cccuuugcuaaaaagaacc

SEQ ID NO: 1650 - RNA, 19 nt, Artificial Sequence
  Description of Artificial Sequence: Synthetic oligonucleotide
ccuuugcuaaaaagaacca

SEQ ID NO: 1651 - RNA, 19 nt, Artificial Sequence
  Description of Artificial Sequence: Synthetic oligonucleotide
cuuugcuaaaaagaaccau

SEQ ID NO: 1652 - RNA, 19 nt, Artificial Sequence
  Description of Artificial Sequence: Synthetic oligonucleotide
uuugcuaaaaagaaccaua

SEQ ID NO: 1653 - RNA, 19 nt, Artificial Sequence
  Description of Artificial Sequence: Synthetic oligonucleotide
uugcuaaaaagaaccauau

SEQ ID NO: 1654 - RNA, 19 nt, Artificial Sequence
  Description of Artificial Sequence: Synthetic oligonucleotide
ugcuaaaaagaaccauauu

SEQ ID NO: 1655 - RNA, 19 nt, Artificial Sequence
  Description of Artificial Sequence: Synthetic oligonucleotide
gcuaaaaagaaccauauua

SEQ ID NO: 1656 - RNA, 19 nt, Artificial Sequence
  Description of Artificial Sequence: Synthetic oligonucleotide
cuaaaaagaaccauauuau

SEQ ID NO: 1657 - RNA, 19 nt, Artificial Sequence
  Description of Artificial Sequence: Synthetic oligonucleotide
uaaaaagaaccauauuauu

SEQ ID NO: 1658 - RNA, 19 nt, Artificial Sequence
  Description of Artificial Sequence: Synthetic oligonucleotide
aaaaagaaccauauuauuu

SEQ ID NO: 1659 - RNA, 19 nt, Artificial Sequence
  Description of Artificial Sequence: Synthetic oligonucleotide
aaaagaaccauauuauuuu

SEQ ID NO: 1660 - RNA, 19 nt, Artificial Sequence
  Description of Artificial Sequence: Synthetic oligonucleotide
aaagaaccauauuauuuug

SEQ ID NO: 1661 - RNA, 19 nt, Artificial Sequence
  Description of Artificial Sequence: Synthetic oligonucleotide
aagaaccauauuauuuuga

SEQ ID NO: 1662 - RNA, 19 nt, Artificial Sequence
  Description of Artificial Sequence: Synthetic oligonucleotide
agaaccauauuauuuugau

SEQ ID NO: 1663 - RNA, 19 nt, Artificial Sequence
  Description of Artificial Sequence: Synthetic oligonucleotide
gaaccauauuauuuugauu

SEQ ID NO: 1664 - RNA, 19 nt, Artificial Sequence
  Description of Artificial Sequence: Synthetic oligonucleotide
aaccauauuauuuugauuc

SEQ ID NO: 1665 - RNA, 19 nt, Artificial Sequence
  Description of Artificial Sequence: Synthetic oligonucleotide
accauauuauuuugauucu

SEQ ID NO: 1666 - RNA, 19 nt, Artificial Sequence
  Description of Artificial Sequence: Synthetic oligonucleotide
ccauauuauuuugauucuc

SEQ ID NO: 1667 - RNA, 19 nt, Artificial Sequence
  Description of Artificial Sequence: Synthetic oligonucleotide
cauauuauuuugauucuca

SEQ ID NO: 1668 - RNA, 19 nt, Artificial Sequence
  Description of Artificial Sequence: Synthetic oligonucleotide
auauuauuuugauucucaa

SEQ ID NO: 1669 - RNA, 19 nt, Artificial Sequence
  Description of Artificial Sequence: Synthetic oligonucleotide
uauuauuuugauucucaaa

SEQ ID NO: 1670 - RNA, 19 nt, Artificial Sequence
  Description of Artificial Sequence: Synthetic oligonucleotide
auuauuuugauucucaaag

SEQ ID NO: 1671 - RNA, 19 nt, Artificial Sequence
  Description of Artificial Sequence: Synthetic oligonucleotide
uuauuuugauucucaaagg

SEQ ID NO: 1672 - RNA, 19 nt, Artificial Sequence
  Description of Artificial Sequence: Synthetic oligonucleotide
uauuuugauucucaaagga

SEQ ID NO: 1673 - RNA, 19 nt, Artificial Sequence
  Description of Artificial Sequence: Synthetic oligonucleotide
auuuugauucucaaaggau

SEQ ID NO: 1674 - RNA, 19 nt, Artificial Sequence
  Description of Artificial Sequence: Synthetic oligonucleotide
uuuugauucucaaaggaua

SEQ ID NO: 1675 - RNA, 19 nt, Artificial Sequence
  Description of Artificial Sequence: Synthetic oligonucleotide
uuugauucucaaaggauag

SEQ ID NO: 1676 - RNA, 19 nt, Artificial Sequence
  Description of Artificial Sequence: Synthetic oligonucleotide
uugauucucaaaggauagg

SEQ ID NO: 1677 - RNA, 19 nt, Artificial Sequence
  Description of Artificial Sequence: Synthetic oligonucleotide
ugauucucaaaggauaggc

SEQ ID NO: 1678 - RNA, 19 nt, Artificial Sequence
  Description of Artificial Sequence: Synthetic oligonucleotide
gauucucaaaggauaggcc

SEQ ID NO: 1679 - RNA, 19 nt, Artificial Sequence
  Description of Artificial Sequence: Synthetic oligonucleotide
auucucaaaggauaggccu

SEQ ID NO: 1680 - RNA, 19 nt, Artificial Sequence
  Description of Artificial Sequence: Synthetic oligonucleotide
uucucaaaggauaggccuu

SEQ ID NO: 1681 - RNA, 19 nt, Artificial Sequence
  Description of Artificial Sequence: Synthetic oligonucleotide
ucucaaaggauaggccuuu

SEQ ID NO: 1682 - RNA, 19 nt, Artificial Sequence
  Description of Artificial Sequence: Synthetic oligonucleotide
cucaaaggauaggccuuug

SEQ ID NO: 1683 - RNA, 19 nt, Artificial Sequence
  Description of Artificial Sequence: Synthetic oligonucleotide
ucaaaggauaggccuuuga

SEQ ID NO: 1684 - RNA, 19 nt, Artificial Sequence
  Description of Artificial Sequence: Synthetic oligonucleotide
caaaggauaggccuuugag

SEQ ID NO: 1685 - RNA, 19 nt, Artificial Sequence
  Description of Artificial Sequence: Synthetic oligonucleotide
aaaggauaggccuuugagu

SEQ ID NO: 1686 - RNA, 19 nt, Artificial Sequence
  Description of Artificial Sequence: Synthetic oligonucleotide
aaggauaggccuuugagug

SEQ ID NO: 1687 - RNA, 19 nt, Artificial Sequence
  Description of Artificial Sequence: Synthetic oligonucleotide
aggauaggccuuugagugu

SEQ ID NO: 1688 - RNA, 19 nt, Artificial Sequence
  Description of Artificial Sequence: Synthetic oligonucleotide
ggauaggccuuugaguguu

SEQ ID NO: 1689 - RNA, 19 nt, Artificial Sequence
  Description of Artificial Sequence: Synthetic oligonucleotide
gauaggccuuugaguguua

SEQ ID NO: 1690 - RNA, 19 nt, Artificial Sequence
  Description of Artificial Sequence: Synthetic oligonucleotide
auaggccuuugaguguuag

SEQ ID NO: 1691 - RNA, 19 nt, Artificial Sequence
  Description of Artificial Sequence: Synthetic oligonucleotide
uaggccuuugaguguuaga

SEQ ID NO: 1692 - RNA, 19 nt, Artificial Sequence
  Description of Artificial Sequence: Synthetic oligonucleotide
aggccuuugaguguuagag

SEQ ID NO: 1693 - RNA, 19 nt, Artificial Sequence
  Description of Artificial Sequence: Synthetic oligonucleotide
ggccuuugaguguuagaga

SEQ ID NO: 1694 - RNA, 19 nt, Artificial Sequence
  Description of Artificial Sequence: Synthetic oligonucleotide
gccuuugaguguuagagaa

SEQ ID NO: 1695 - RNA, 19 nt, Artificial Sequence
  Description of Artificial Sequence: Synthetic oligonucleotide
ccuuugaguguuagagaaa

SEQ ID NO: 1696 - RNA, 19 nt, Artificial Sequence
  Description of Artificial Sequence: Synthetic oligonucleotide
cuuugaguguuagagaaag

SEQ ID NO: 1697 - RNA, 19 nt, Artificial Sequence
  Description of Artificial Sequence: Synthetic oligonucleotide
uuugaguguuagagaaagg

SEQ ID NO: 1698 - RNA, 19 nt, Artificial Sequence
  Description of Artificial Sequence: Synthetic oligonucleotide
uugaguguuagagaaagga

SEQ ID NO: 1699 - RNA, 19 nt, Artificial Sequence
  Description of Artificial Sequence: Synthetic oligonucleotide
ugaguguuagagaaaggag

SEQ ID NO: 1700 - RNA, 19 nt, Artificial Sequence
  Description of Artificial Sequence: Synthetic oligonucleotide
gaguguuagagaaaggagu

SEQ ID NO: 1701 - RNA, 19 nt, Artificial Sequence
  Description of Artificial Sequence: Synthetic oligonucleotide
aguguuagagaaaggagug

SEQ ID NO: 1702 - RNA, 19 nt, Artificial Sequence
  Description of Artificial Sequence: Synthetic oligonucleotide
guguuagagaaaggaguga

SEQ ID NO: 1703 - RNA, 19 nt, Artificial Sequence
  Description of Artificial Sequence: Synthetic oligonucleotide
uguuagagaaaggagugaa

SEQ ID NO: 1704 - RNA, 19 nt, Artificial Sequence
  Description of Artificial Sequence: Synthetic oligonucleotide
guuagagaaaggagugaag

SEQ ID NO: 1705 - RNA, 19 nt, Artificial Sequence
  Description of Artificial Sequence: Synthetic oligonucleotide
uuagagaaaggagugaagg

SEQ ID NO: 1706 - RNA, 19 nt, Artificial Sequence
  Description of Artificial Sequence: Synthetic oligonucleotide
uagagaaaggagugaagga

SEQ ID NO: 1707 - RNA, 19 nt, Artificial Sequence
  Description of Artificial Sequence: Synthetic oligonucleotide
agagaaaggagugaaggag

SEQ ID NO: 1708 - RNA, 19 nt, Artificial Sequence
  Description of Artificial Sequence: Synthetic oligonucleotide
gagaaaggagugaaggagg

SEQ ID NO: 1709 - RNA, 19 nt, Artificial Sequence
  Description of Artificial Sequence: Synthetic oligonucleotide
agaaaggagugaaggaggc

SEQ ID NO: 1710 - RNA, 19 nt, Artificial Sequence
  Description of Artificial Sequence: Synthetic oligonucleotide
gaaaggagugaaggaggca

SEQ ID NO: 1711 - RNA, 19 nt, Artificial Sequence
  Description of Artificial Sequence: Synthetic oligonucleotide
aaaggagugaaggaggcag

SEQ ID NO: 1712 - RNA, 19 nt, Artificial Sequence
  Description of Artificial Sequence: Synthetic oligonucleotide
aaggagugaaggaggcagg

SEQ ID NO: 1713 - RNA, 19 nt, Artificial Sequence
  Description of Artificial Sequence: Synthetic oligonucleotide
aggagugaaggaggcaggu

SEQ ID NO: 1714 - RNA, 19 nt, Artificial Sequence
  Description of Artificial Sequence: Synthetic oligonucleotide
ggagugaaggaggcaggug

SEQ ID NO: 1715 - RNA, 19 nt, Artificial Sequence
  Description of Artificial Sequence: Synthetic oligonucleotide
gagugaaggaggcaggugg

SEQ ID NO: 1716 - RNA, 19 nt, Artificial Sequence
  Description of Artificial Sequence: Synthetic oligonucleotide
agugaaggaggcagguggg

SEQ ID NO: 1717 - RNA, 19 nt, Artificial Sequence
  Description of Artificial Sequence: Synthetic oligonucleotide
gugaaggaggcagguggga

SEQ ID NO: 1718 - RNA, 19 nt, Artificial Sequence
  Description of Artificial Sequence: Synthetic oligonucleotide
ugaaggaggcaggugggaa

SEQ ID NO: 1719 - RNA, 19 nt, Artificial Sequence
  Description of Artificial Sequence: Synthetic oligonucleotide
gaaggaggcaggugggaaa

SEQ ID NO: 1720 - RNA, 19 nt, Artificial Sequence
  Description of Artificial Sequence: Synthetic oligonucleotide
aaggaggcaggugggaaau

SEQ ID NO: 1721 - RNA, 19 nt, Artificial Sequence
  Description of Artificial Sequence: Synthetic oligonucleotide
aggaggcaggugggaaaug

SEQ ID NO: 1722 - RNA, 19 nt, Artificial Sequence
  Description of Artificial Sequence: Synthetic oligonucleotide
ggaggcaggugggaaaugg

SEQ ID NO: 1723 - RNA, 19 nt, Artificial Sequence
  Description of Artificial Sequence: Synthetic oligonucleotide
gaggcaggugggaaauggu

SEQ ID NO: 1724 - RNA, 19 nt, Artificial Sequence
  Description of Artificial Sequence: Synthetic oligonucleotide
aggcaggugggaaauggua

SEQ ID NO: 1725 - RNA, 19 nt, Artificial Sequence
  Description of Artificial Sequence: Synthetic oligonucleotide
ggcaggugggaaaugguau

SEQ ID NO: 1726 - RNA, 19 nt, Artificial Sequence
  Description of Artificial Sequence: Synthetic oligonucleotide
gcaggugggaaaugguauu

SEQ ID NO: 1727 - RNA, 19 nt, Artificial Sequence
  Description of Artificial Sequence: Synthetic oligonucleotide
caggugggaaaugguauuu

SEQ ID NO: 1728 - RNA, 19 nt, Artificial Sequence
  Description of Artificial Sequence: Synthetic oligonucleotide
aggugggaaaugguauuuc

SEQ ID NO: 1729 - RNA, 19 nt, Artificial Sequence
  Description of Artificial Sequence: Synthetic oligonucleotide
ggugggaaaugguauuucu

SEQ ID NO: 1730 - RNA, 19 nt, Artificial Sequence
  Description of Artificial Sequence: Synthetic oligonucleotide
gugggaaaugguauuucua

SEQ ID NO: 1731 - RNA, 19 nt, Artificial Sequence
  Description of Artificial Sequence: Synthetic oligonucleotide
ugggaaaugguauuucuau

SEQ ID NO: 1732 - RNA, 19 nt, Artificial Sequence
  Description of Artificial Sequence: Synthetic oligonucleotide
gggaaaugguauuucuauu

SEQ ID NO: 1733 - RNA, 19 nt, Artificial Sequence
  Description of Artificial Sequence: Synthetic oligonucleotide
ggaaaugguauuucuauuu

SEQ ID NO: 1734 - RNA, 19 nt, Artificial Sequence
  Description of Artificial Sequence: Synthetic oligonucleotide
gaaaugguauuucuauuuu

SEQ ID NO: 1735 - RNA, 19 nt, Artificial Sequence
  Description of Artificial Sequence: Synthetic oligonucleotide
aaaugguauuucuauuuuu

SEQ ID NO: 1736 - RNA, 19 nt, Artificial Sequence
  Description of Artificial Sequence: Synthetic oligonucleotide
aaugguauuucuauuuuua

SEQ ID NO: 1737 - RNA, 19 nt, Artificial Sequence
  Description of Artificial Sequence: Synthetic oligonucleotide
augguauuucuauuuuuaa

SEQ ID NO: 1738 - RNA, 19 nt, Artificial Sequence
  Description of Artificial Sequence: Synthetic oligonucleotide
ugguauuucuauuuuuaaa

SEQ ID NO: 1739 - RNA, 19 nt, Artificial Sequence
  Description of Artificial Sequence: Synthetic oligonucleotide
gguauuucuauuuuuaaau

SEQ ID NO: 1740 - RNA, 19 nt, Artificial Sequence
  Description of Artificial Sequence: Synthetic oligonucleotide
guauuucuauuuuuaaauc

SEQ ID NO: 1741 - RNA, 19 nt, Artificial Sequence
  Description of Artificial Sequence: Synthetic oligonucleotide
uauuucuauuuuuaaaucc

SEQ ID NO: 1742 - RNA, 19 nt, Artificial Sequence
  Description of Artificial Sequence: Synthetic oligonucleotide
auuucuauuuuuaaaucca

SEQ ID NO: 1743 - RNA, 19 nt, Artificial Sequence
  Description of Artificial Sequence: Synthetic oligonucleotide
uuucuauuuuuaaauccag

SEQ ID NO: 1744 - RNA, 19 nt, Artificial Sequence
  Description of Artificial Sequence: Synthetic oligonucleotide
uucuauuuuuaaauccagu

SEQ ID NO: 1745 - RNA, 19 nt, Artificial Sequence
  Description of Artificial Sequence: Synthetic oligonucleotide
ucuauuuuuaaauccagug

SEQ ID NO: 1746 - RNA, 19 nt, Artificial Sequence
  Description of Artificial Sequence: Synthetic oligonucleotide
cuauuuuuaaauccaguga

SEQ ID NO: 1747 - RNA, 19 nt, Artificial Sequence
  Description of Artificial Sequence: Synthetic oligonucleotide
uauuuuuaaauccagugaa

SEQ ID NO: 1748 - RNA, 19 nt, Artificial Sequence
  Description of Artificial Sequence: Synthetic oligonucleotide
auuuuuaaauccagugaaa

SEQ ID NO: 1749 - RNA, 19 nt, Artificial Sequence
  Description of Artificial Sequence: Synthetic oligonucleotide
uuuuuaaauccagugaaau

SEQ ID NO: 1750 - RNA, 19 nt, Artificial Sequence
  Description of Artificial Sequence: Synthetic oligonucleotide
uuuuaaauccagugaaauu

SEQ ID NO: 1751 - RNA, 19 nt, Artificial Sequence
  Description of Artificial Sequence: Synthetic oligonucleotide
uuuaaauccagugaaauua

SEQ ID NO: 1752 - RNA, 19 nt, Artificial Sequence
  Description of Artificial Sequence: Synthetic oligonucleotide
uuaaauccagugaaauuau

SEQ ID NO: 1753 - RNA, 19 nt, Artificial Sequence
  Description of Artificial Sequence: Synthetic oligonucleotide
uaaauccagugaaauuauc

SEQ ID NO: 1754 - RNA, 19 nt, Artificial Sequence
  Description of Artificial Sequence: Synthetic oligonucleotide
aaauccagugaaauuaucu

SEQ ID NO: 1755 - RNA, 19 nt, Artificial Sequence
  Description of Artificial Sequence: Synthetic oligonucleotide
aauccagugaaauuaucuu

SEQ ID NO: 1756 - RNA, 19 nt, Artificial Sequence
  Description of Artificial Sequence: Synthetic oligonucleotide
auccagugaaauuaucuug

SEQ ID NO: 1757 - RNA, 19 nt, Artificial Sequence
  Description of Artificial Sequence: Synthetic oligonucleotide
uccagugaaauuaucuuga

SEQ ID NO: 1758 - RNA, 19 nt, Artificial Sequence
  Description of Artificial Sequence: Synthetic oligonucleotide
ccagugaaauuaucuugag

SEQ ID NO: 1759 - RNA, 19 nt, Artificial Sequence
  Description of Artificial Sequence: Synthetic oligonucleotide
cagugaaauuaucuugagu

SEQ ID NO: 1760 - RNA, 19 nt, Artificial Sequence
  Description of Artificial Sequence: Synthetic oligonucleotide
agugaaauuaucuugaguc

SEQ ID NO: 1761 - RNA, 19 nt, Artificial Sequence
  Description of Artificial Sequence: Synthetic oligonucleotide
gugaaauuaucuugagucu

SEQ ID NO: 1762 - RNA, 19 nt, Artificial Sequence
  Description of Artificial Sequence: Synthetic oligonucleotide
ugaaauuaucuugagucua

SEQ ID NO: 1763 - RNA, 19 nt, Artificial Sequence
  Description of Artificial Sequence: Synthetic oligonucleotide
gaaauuaucuugagucuac

SEQ ID NO: 1764 - RNA, 19 nt, Artificial Sequence
  Description of Artificial Sequence: Synthetic oligonucleotide
aaauuaucuugagucuaca

SEQ ID NO: 1765 - RNA, 19 nt, Artificial Sequence
  Description of Artificial Sequence: Synthetic oligonucleotide
aauuaucuugagucuacac

SEQ ID NO: 1766 - RNA, 19 nt, Artificial Sequence
  Description of Artificial Sequence: Synthetic oligonucleotide
auuaucuugagucuacaca

SEQ ID NO: 1767 - RNA, 19 nt, Artificial Sequence
  Description of Artificial Sequence: Synthetic oligonucleotide
uuaucuugagucuacacau

SEQ ID NO: 1768 - RNA, 19 nt, Artificial Sequence
  Description of Artificial Sequence: Synthetic oligonucleotide
uaucuugagucuacacauu

SEQ ID NO: 1769 - RNA, 19 nt, Artificial Sequence
  Description of Artificial Sequence: Synthetic oligonucleotide
aucuugagucuacacauua

SEQ ID NO: 1770 - RNA, 19 nt, Artificial Sequence
  Description of Artificial Sequence: Synthetic oligonucleotide
ucuugagucuacacauuau

SEQ ID NO: 1771 - RNA, 19 nt, Artificial Sequence
  Description of Artificial Sequence: Synthetic oligonucleotide
cuugagucuacacauuauu

SEQ ID NO: 1772 - RNA, 19 nt, Artificial Sequence
  Description of Artificial Sequence: Synthetic oligonucleotide
uugagucuacacauuauuu

SEQ ID NO: 1773 - RNA, 19 nt, Artificial Sequence
  Description of Artificial Sequence: Synthetic oligonucleotide
ugagucuacacauuauuuu

SEQ ID NO: 1774 - RNA, 19 nt, Artificial Sequence
  Description of Artificial Sequence: Synthetic oligonucleotide
gagucuacacauuauuuuu

SEQ ID NO: 1775 - RNA, 19 nt, Artificial Sequence
  Description of Artificial Sequence: Synthetic oligonucleotide
agucuacacauuauuuuua

SEQ ID NO: 1776 - RNA, 19 nt, Artificial Sequence
  Description of Artificial Sequence: Synthetic oligonucleotide
gucuacacauuauuuuuaa

SEQ ID NO: 1777 - RNA, 19 nt, Artificial Sequence
  Description of Artificial Sequence: Synthetic oligonucleotide
ucuacacauuauuuuuaaa

SEQ ID NO: 1778 - RNA, 19 nt, Artificial Sequence
  Description of Artificial Sequence: Synthetic oligonucleotide
cuacacauuauuuuuaaaa

SEQ ID NO: 1779 - RNA, 19 nt, Artificial Sequence
  Description of Artificial Sequence: Synthetic oligonucleotide
uacacauuauuuuuaaaac

SEQ ID NO: 1780 - RNA, 19 nt, Artificial Sequence
  Description of Artificial Sequence: Synthetic oligonucleotide
acacauuauuuuuaaaaca

SEQ ID NO: 1781 - RNA, 19 nt, Artificial Sequence
  Description of Artificial Sequence: Synthetic oligonucleotide
cacauuauuuuuaaaacac

SEQ ID NO: 1782 - RNA, 19 nt, Artificial Sequence
  Description of Artificial Sequence: Synthetic oligonucleotide
acauuauuuuuaaaacaca

SEQ ID NO: 1783 - RNA, 19 nt, Artificial Sequence
  Description of Artificial Sequence: Synthetic oligonucleotide
cauuauuuuuaaaacacaa

SEQ ID NO: 1784 - RNA, 19 nt, Artificial Sequence
  Description of Artificial Sequence: Synthetic oligonucleotide
auuauuuuuaaaacacaaa

SEQ ID NO: 1785 - RNA, 19 nt, Artificial Sequence
  Description of Artificial Sequence: Synthetic oligonucleotide
uuauuuuuaaaacacaaaa

SEQ ID NO: 1786 - RNA, 19 nt, Artificial Sequence
  Description of Artificial Sequence: Synthetic oligonucleotide
uauuuuuaaaacacaaaaa

SEQ ID NO: 1787 - RNA, 19 nt, Artificial Sequence
  Description of Artificial Sequence: Synthetic oligonucleotide
auuuuuaaaacacaaaaau

SEQ ID NO: 1788 - RNA, 19 nt, Artificial Sequence
  Description of Artificial Sequence: Synthetic oligonucleotide
uuuuuaaaacacaaaaauu

SEQ ID NO: 1789 - RNA, 19 nt, Artificial Sequence
  Description of Artificial Sequence: Synthetic oligonucleotide
uuuuaaaacacaaaaauug

SEQ ID NO: 1790 - RNA, 19 nt, Artificial Sequence
  Description of Artificial Sequence: Synthetic oligonucleotide
uuuaaaacacaaaaauugu

SEQ ID NO: 1791 - RNA, 19 nt, Artificial Sequence
  Description of Artificial Sequence: Synthetic oligonucleotide
uuaaaacacaaaaauuguu

SEQ ID NO: 1792 - RNA, 19 nt, Artificial Sequence
  Description of Artificial Sequence: Synthetic oligonucleotide
uaaaacacaaaaauuguuc

SEQ ID NO: 1793 - RNA, 19 nt, Artificial Sequence
  Description of Artificial Sequence: Synthetic oligonucleotide
aaaacacaaaaauuguucg

SEQ ID NO: 1794 - RNA, 19 nt, Artificial Sequence
  Description of Artificial Sequence: Synthetic oligonucleotide
aaacacaaaaauuguucgg

SEQ ID NO: 1795 - RNA, 19 nt, Artificial Sequence
  Description of Artificial Sequence: Synthetic oligonucleotide
aacacaaaaauuguucggc

SEQ ID NO: 1796 - RNA, 19 nt, Artificial Sequence
  Description of Artificial Sequence: Synthetic oligonucleotide
acacaaaaauuguucggcu

SEQ ID NO: 1797 - RNA, 19 nt, Artificial Sequence
  Description of Artificial Sequence: Synthetic oligonucleotide
cacaaaaauuguucggcug

SEQ ID NO: 1798 - RNA, 19 nt, Artificial Sequence
  Description of Artificial Sequence: Synthetic oligonucleotide
acaaaaauuguucggcugg

SEQ ID NO: 1799 - RNA, 19 nt, Artificial Sequence
  Description of Artificial Sequence: Synthetic oligonucleotide
caaaaauuguucggcugga

SEQ ID NO: 1800 - RNA, 19 nt, Artificial Sequence
  Description of Artificial Sequence: Synthetic oligonucleotide
aaaaauuguucggcuggaa

SEQ ID NO: 1801 - RNA, 19 nt, Artificial Sequence
  Description of Artificial Sequence: Synthetic oligonucleotide
aaaauuguucggcuggaac

SEQ ID NO: 1802 - RNA, 19 nt, Artificial Sequence
  Description of Artificial Sequence: Synthetic oligonucleotide
aaauuguucggcuggaacu

SEQ ID NO: 1803 - RNA, 19 nt, Artificial Sequence
  Description of Artificial Sequence: Synthetic oligonucleotide
aauuguucggcuggaacug

SEQ ID NO: 1804 - RNA, 19 nt, Artificial Sequence
  Description of Artificial Sequence: Synthetic oligonucleotide
auuguucggcuggaacuga

SEQ ID NO: 1805 - RNA, 19 nt, Artificial Sequence
  Description of Artificial Sequence: Synthetic oligonucleotide
uuguucggcuggaacugac

SEQ ID NO: 1806 - RNA, 19 nt, Artificial Sequence
  Description of Artificial Sequence: Synthetic oligonucleotide
uguucggcuggaacugacc

SEQ ID NO: 1807 - RNA, 19 nt, Artificial Sequence
  Description of Artificial Sequence: Synthetic oligonucleotide
guucggcuggaacugaccc

SEQ ID NO: 1808 - RNA, 19 nt, Artificial Sequence
  Description of Artificial Sequence: Synthetic oligonucleotide
uucggcuggaacugaccca

SEQ ID NO: 1809 - RNA, 19 nt, Artificial Sequence
  Description of Artificial Sequence: Synthetic oligonucleotide
ucggcuggaacugacccag

SEQ ID NO: 1810 - RNA, 19 nt, Artificial Sequence
  Description of Artificial Sequence: Synthetic oligonucleotide
cggcuggaacugacccagg

SEQ ID NO: 1811 - RNA, 19 nt, Artificial Sequence
  Description of Artificial Sequence: Synthetic oligonucleotide
ggcuggaacugacccaggc

SEQ ID NO: 1812 - RNA, 19 nt, Artificial Sequence
  Description of Artificial Sequence: Synthetic oligonucleotide
gcuggaacugacccaggcu

SEQ ID NO: 1813 - RNA, 19 nt, Artificial Sequence
  Description of Artificial Sequence: Synthetic oligonucleotide
cuggaacugacccaggcug

SEQ ID NO: 1814 - RNA, 19 nt, Artificial Sequence
  Description of Artificial Sequence: Synthetic oligonucleotide
uggaacugacccaggcugg

SEQ ID NO: 1815 - RNA, 19 nt, Artificial Sequence
  Description of Artificial Sequence: Synthetic oligonucleotide
ggaacugacccaggcugga

SEQ ID NO: 1816 - RNA, 19 nt, Artificial Sequence
  Description of Artificial Sequence: Synthetic oligonucleotide
gaacugacccaggcuggac

SEQ ID NO: 1817 - RNA, 19 nt, Artificial Sequence
  Description of Artificial Sequence: Synthetic oligonucleotide
aacugacccaggcuggacu

SEQ ID NO: 1818 - RNA, 19 nt, Artificial Sequence
  Description of Artificial Sequence: Synthetic oligonucleotide
acugacccaggcuggacuu

SEQ ID NO: 1819 - RNA, 19 nt, Artificial Sequence
  Description of Artificial Sequence: Synthetic oligonucleotide
cugacccaggcuggacuug

SEQ ID NO: 1820 - RNA, 19 nt, Artificial Sequence
  Description of Artificial Sequence: Synthetic oligonucleotide
ugacccaggcuggacuugc

SEQ ID NO: 1821 - RNA, 19 nt, Artificial Sequence
  Description of Artificial Sequence: Synthetic oligonucleotide
gacccaggcuggacuugcg

SEQ ID NO: 1822 - RNA, 19 nt, Artificial Sequence
  Description of Artificial Sequence: Synthetic oligonucleotide
acccaggcuggacuugcgg

SEQ ID NO: 1823 - RNA, 19 nt, Artificial Sequence
  Description of Artificial Sequence: Synthetic oligonucleotide
cccaggcuggacuugcggg

SEQ ID NO: 1824 - RNA, 19 nt, Artificial Sequence
  Description of Artificial Sequence: Synthetic oligonucleotide
ccaggcuggacuugcgggg

SEQ ID NO: 1825 - RNA, 19 nt, Artificial Sequence
  Description of Artificial Sequence: Synthetic oligonucleotide
caggcuggacuugcgggga

SEQ ID NO: 1826 - RNA, 19 nt, Artificial Sequence
  Description of Artificial Sequence: Synthetic oligonucleotide
aggcuggacuugcggggag

SEQ ID NO: 1827 - RNA, 19 nt, Artificial Sequence
  Description of Artificial Sequence: Synthetic oligonucleotide
ggcuggacuugcggggagg

SEQ ID NO: 1828 - RNA, 19 nt, Artificial Sequence
  Description of Artificial Sequence: Synthetic oligonucleotide
gcuggacuugcggggagga

SEQ ID NO: 1829 - RNA, 19 nt, Artificial Sequence
  Description of Artificial Sequence: Synthetic oligonucleotide
cuggacuugcggggaggaa

SEQ ID NO: 1830 - RNA, 19 nt, Artificial Sequence
  Description of Artificial Sequence: Synthetic oligonucleotide
uggacuugcggggaggaaa

SEQ ID NO: 1831 - RNA, 19 nt, Artificial Sequence
  Description of Artificial Sequence: Synthetic oligonucleotide
ggacuugcggggaggaaac

SEQ ID NO: 1832 - RNA, 19 nt, Artificial Sequence
  Description of Artificial Sequence: Synthetic oligonucleotide
gacuugcggggaggaaacu

SEQ ID NO: 1833 - RNA, 19 nt, Artificial Sequence
  Description of Artificial Sequence: Synthetic oligonucleotide
acuugcggggaggaaacuc

SEQ ID NO: 1834 - RNA, 19 nt, Artificial Sequence
  Description of Artificial Sequence: Synthetic oligonucleotide
cuugcggggaggaaacucc

SEQ ID NO: 1835 - RNA, 19 nt, Artificial Sequence
  Description of Artificial Sequence: Synthetic oligonucleotide
uugcggggaggaaacucca

SEQ ID NO: 1836 - RNA, 19 nt, Artificial Sequence
  Description of Artificial Sequence: Synthetic oligonucleotide
ugcggggaggaaacuccag

SEQ ID NO: 1837 - RNA, 19 nt, Artificial Sequence
  Description of Artificial Sequence: Synthetic oligonucleotide
gcggggaggaaacuccagg

SEQ ID NO: 1838 - RNA, 19 nt, Artificial Sequence
  Description of Artificial Sequence: Synthetic oligonucleotide
cggggaggaaacuccaggg

SEQ ID NO: 1839 - RNA, 19 nt, Artificial Sequence
  Description of Artificial Sequence: Synthetic oligonucleotide
ggggaggaaacuccagggc

SEQ ID NO: 1840 - RNA, 19 nt, Artificial Sequence
  Description of Artificial Sequence: Synthetic oligonucleotide
gggaggaaacuccagggca

SEQ ID NO: 1841 - RNA, 19 nt, Artificial Sequence
  Description of Artificial Sequence: Synthetic oligonucleotide
ggaggaaacuccagggcac

SEQ ID NO: 1842 - RNA, 19 nt, Artificial Sequence
  Description of Artificial Sequence: Synthetic oligonucleotide
gaggaaacuccagggcacu

SEQ ID NO: 1843 - RNA, 19 nt, Artificial Sequence
  Description of Artificial Sequence: Synthetic oligonucleotide
aggaaacuccagggcacug

SEQ ID NO: 1844 - RNA, 19 nt, Artificial Sequence
  Description of Artificial Sequence: Synthetic oligonucleotide
ggaaacuccagggcacugc

SEQ ID NO: 1845 - RNA, 19 nt, Artificial Sequence
  Description of Artificial Sequence: Synthetic oligonucleotide
gaaacuccagggcacugca

SEQ ID NO: 1846 - RNA, 19 nt, Artificial Sequence
  Description of Artificial Sequence: Synthetic oligonucleotide
aaacuccagggcacugcau

SEQ ID NO: 1847 - RNA, 19 nt, Artificial Sequence
  Description of Artificial Sequence: Synthetic oligonucleotide
aacuccagggcacugcauc

SEQ ID NO: 1848 - RNA, 19 nt, Artificial Sequence
  Description of Artificial Sequence: Synthetic oligonucleotide
acuccagggcacugcaucu

SEQ ID NO: 1849 - RNA, 19 nt, Artificial Sequence
  Description of Artificial Sequence: Synthetic oligonucleotide
cuccagggcacugcaucug

SEQ ID NO: 1850 - RNA, 19 nt, Artificial Sequence
  Description of Artificial Sequence: Synthetic oligonucleotide
uccagggcacugcaucugg

SEQ ID NO: 1851 - RNA, 19 nt, Artificial Sequence
  Description of Artificial Sequence: Synthetic oligonucleotide
ccagggcacugcaucuggc

SEQ ID NO: 1852 - RNA, 19 nt, Artificial Sequence
  Description of Artificial Sequence: Synthetic oligonucleotide
cagggcacugcaucuggcg

SEQ ID NO: 1853 - RNA, 19 nt, Artificial Sequence
  Description of Artificial Sequence: Synthetic oligonucleotide
agggcacugcaucuggcga

SEQ ID NO: 1854 - RNA, 19 nt, Artificial Sequence
  Description of Artificial Sequence: Synthetic oligonucleotide
gggcacugcaucuggcgau

SEQ ID NO: 1855 - RNA, 19 nt, Artificial Sequence
  Description of Artificial Sequence: Synthetic oligonucleotide
ggcacugcaucuggcgauc

SEQ ID NO: 1856 - RNA, 19 nt, Artificial Sequence
  Description of Artificial Sequence: Synthetic oligonucleotide
gcacugcaucuggcgauca

SEQ ID NO: 1857 - RNA, 19 nt, Artificial Sequence
  Description of Artificial Sequence: Synthetic oligonucleotide
cacugcaucuggcgaucag

SEQ ID NO: 1858 - RNA, 19 nt, Artificial Sequence
  Description of Artificial Sequence: Synthetic oligonucleotide
acugcaucuggcgaucaga

SEQ ID NO: 1859 - RNA, 19 nt, Artificial Sequence
  Description of Artificial Sequence: Synthetic oligonucleotide
cugcaucuggcgaucagac

SEQ ID NO: 1860 - RNA, 19 nt, Artificial Sequence
  Description of Artificial Sequence: Synthetic oligonucleotide
ugcaucuggcgaucagacu

SEQ ID NO: 1861 - RNA, 19 nt, Artificial Sequence
  Description of Artificial Sequence: Synthetic oligonucleotide
gcaucuggcgaucagacuc

SEQ ID NO: 1862 - RNA, 19 nt, Artificial Sequence
  Description of Artificial Sequence: Synthetic oligonucleotide
caucuggcgaucagacucu

SEQ ID NO: 1863 - RNA, 19 nt, Artificial Sequence
  Description of Artificial Sequence: Synthetic oligonucleotide
aucuggcgaucagacucug

SEQ ID NO: 1864 - RNA, 19 nt, Artificial Sequence
  Description of Artificial Sequence: Synthetic oligonucleotide
ucuggcgaucagacucuga

SEQ ID NO: 1865 - RNA, 19 nt, Artificial Sequence
  Description of Artificial Sequence: Synthetic oligonucleotide
cuggcgaucagacucugag

SEQ ID NO: 1866 - RNA, 19 nt, Artificial Sequence
  Description of Artificial Sequence: Synthetic oligonucleotide
uggcgaucagacucugagc

SEQ ID NO: 1867 - RNA, 19 nt, Artificial Sequence
  Description of Artificial Sequence: Synthetic oligonucleotide
ggcgaucagacucugagca

SEQ ID NO: 1868 - RNA, 19 nt, Artificial Sequence
  Description of Artificial Sequence: Synthetic oligonucleotide
gcgaucagacucugagcac

SEQ ID NO: 1869 - RNA, 19 nt, Artificial Sequence
  Description of Artificial Sequence: Synthetic oligonucleotide
cgaucagacucugagcacu

SEQ ID NO: 1870 - RNA, 19 nt, Artificial Sequence
  Description of Artificial Sequence: Synthetic oligonucleotide
gaucagacucugagcacug

SEQ ID NO: 1871 - RNA, 19 nt, Artificial Sequence
  Description of Artificial Sequence: Synthetic oligonucleotide
aucagacucugagcacugc

SEQ ID NO: 1872 - RNA, 19 nt, Artificial Sequence
  Description of Artificial Sequence: Synthetic oligonucleotide
ucagacucugagcacugcc

SEQ ID NO: 1873 - RNA, 19 nt, Artificial Sequence
  Description of Artificial Sequence: Synthetic oligonucleotide
cagacucugagcacugccc

SEQ ID NO: 1874 - RNA, 19 nt, Artificial Sequence
  Description of Artificial Sequence: Synthetic oligonucleotide
agacucugagcacugcccc

SEQ ID NO: 1875 - RNA, 19 nt, Artificial Sequence
  Description of Artificial Sequence: Synthetic oligonucleotide
gacucugagcacugccccu

SEQ ID NO: 1876 - RNA, 19 nt, Artificial Sequence
  Description of Artificial Sequence: Synthetic oligonucleotide
acucugagcacugccccug

SEQ ID NO: 1877 - RNA, 19 nt, Artificial Sequence
  Description of Artificial Sequence: Synthetic oligonucleotide
cucugagcacugccccugc

SEQ ID NO: 1878 - RNA, 19 nt, Artificial Sequence
  Description of Artificial Sequence: Synthetic oligonucleotide
ucugagcacugccccugcu

SEQ ID NO: 1879 - RNA, 19 nt, Artificial Sequence
  Description of Artificial Sequence: Synthetic oligonucleotide
cugagcacugccccugcuc

SEQ ID NO: 1880 - RNA, 19 nt, Artificial Sequence
  Description of Artificial Sequence: Synthetic oligonucleotide
ugagcacugccccugcucg

SEQ ID NO: 1881 - RNA, 19 nt, Artificial Sequence
  Description of Artificial Sequence: Synthetic oligonucleotide
gagcacugccccugcucgc

SEQ ID NO: 1882 - RNA, 19 nt, Artificial Sequence
  Description of Artificial Sequence: Synthetic oligonucleotide
agcacugccccugcucgcc

SEQ ID NO: 1883 - RNA, 19 nt, Artificial Sequence
  Description of Artificial Sequence: Synthetic oligonucleotide
gcacugccccugcucgccu

SEQ ID NO: 1884 - RNA, 19 nt, Artificial Sequence
  Description of Artificial Sequence: Synthetic oligonucleotide
cacugccccugcucgccuu

SEQ ID NO: 1885 - RNA, 19 nt, Artificial Sequence
  Description of Artificial Sequence: Synthetic oligonucleotide
acugccccugcucgccuug

SEQ ID NO: 1886 - RNA, 19 nt, Artificial Sequence
  Description of Artificial Sequence: Synthetic oligonucleotide
cugccccugcucgccuugg

SEQ ID NO: 1887 - RNA, 19 nt, Artificial Sequence
  Description of Artificial Sequence: Synthetic oligonucleotide
ugccccugcucgccuuggu

SEQ ID NO: 1888 - RNA, 19 nt, Artificial Sequence
  Description of Artificial Sequence: Synthetic oligonucleotide
gccccugcucgccuugguc

SEQ ID NO: 1889 - RNA, 19 nt, Artificial Sequence
  Description of Artificial Sequence: Synthetic oligonucleotide
ccccugcucgccuugguca

SEQ ID NO: 1890 - RNA, 19 nt, Artificial Sequence
  Description of Artificial Sequence: Synthetic oligonucleotide
cccugcucgccuuggucau

SEQ ID NO: 1891 - RNA, 19 nt, Artificial Sequence
  Description of Artificial Sequence: Synthetic oligonucleotide
ccugcucgccuuggucaug

SEQ ID NO: 1892 - RNA, 19 nt, Artificial Sequence
  Description of Artificial Sequence: Synthetic oligonucleotide
cugcucgccuuggucaugu

SEQ ID NO: 1893 - RNA, 19 nt, Artificial Sequence
  Description of Artificial Sequence: Synthetic oligonucleotide
ugcucgccuuggucaugua

SEQ ID NO: 1894 - RNA, 19 nt, Artificial Sequence
  Description of Artificial Sequence: Synthetic oligonucleotide
gcucgccuuggucauguac

SEQ ID NO: 1895 - RNA, 19 nt, Artificial Sequence
  Description of Artificial Sequence: Synthetic oligonucleotide
cucgccuuggucauguaca

SEQ ID NO: 1896 - RNA, 19 nt, Artificial Sequence
  Description of Artificial Sequence: Synthetic oligonucleotide
ucgccuuggucauguacag

SEQ ID NO: 1897 - RNA, 19 nt, Artificial Sequence
  Description of Artificial Sequence: Synthetic oligonucleotide
cgccuuggucauguacagc

SEQ ID NO: 1898 - RNA, 19 nt, Artificial Sequence
  Description of Artificial Sequence: Synthetic oligonucleotide
gccuuggucauguacagca

SEQ ID NO: 1899 - RNA, 19 nt, Artificial Sequence
  Description of Artificial Sequence: Synthetic oligonucleotide
ccuuggucauguacagcac

SEQ ID NO: 1900 - RNA, 19 nt, Artificial Sequence
  Description of Artificial Sequence: Synthetic oligonucleotide
cuuggucauguacagcacu

SEQ ID NO: 1901 - RNA, 19 nt, Artificial Sequence
  Description of Artificial Sequence: Synthetic oligonucleotide
uuggucauguacagcacug

SEQ ID NO: 1902 - RNA, 19 nt, Artificial Sequence
  Description of Artificial Sequence: Synthetic oligonucleotide
uggucauguacagcacuga

SEQ ID NO: 1903 - RNA, 19 nt, Artificial Sequence
  Description of Artificial Sequence: Synthetic oligonucleotide
ggucauguacagcacugaa

SEQ ID NO: 1904 - RNA, 19 nt, Artificial Sequence
  Description of Artificial Sequence: Synthetic oligonucleotide
gucauguacagcacugaaa

SEQ ID NO: 1905 - RNA, 19 nt, Artificial Sequence
  Description of Artificial Sequence: Synthetic oligonucleotide
ucauguacagcacugaaag

SEQ ID NO: 1906 - RNA, 19 nt, Artificial Sequence
  Description of Artificial Sequence: Synthetic oligonucleotide
cauguacagcacugaaagg

SEQ ID NO: 1907 - RNA, 19 nt, Artificial Sequence
  Description of Artificial Sequence: Synthetic oligonucleotide
auguacagcacugaaagga

SEQ ID NO: 1908 - RNA, 19 nt, Artificial Sequence
  Description of Artificial Sequence: Synthetic oligonucleotide
uguacagcacugaaaggaa

SEQ ID NO: 1909 - RNA, 19 nt, Artificial Sequence
  Description of Artificial Sequence: Synthetic oligonucleotide
guacagcacugaaaggaau

SEQ ID NO: 1910 - RNA, 19 nt, Artificial Sequence
  Description of Artificial Sequence: Synthetic oligonucleotide
uacagcacugaaaggaaug

SEQ ID NO: 1911 - RNA, 19 nt, Artificial Sequence
  Description of Artificial Sequence: Synthetic oligonucleotide
acagcacugaaaggaauga

SEQ ID NO: 1912 - RNA, 19 nt, Artificial Sequence
  Description of Artificial Sequence: Synthetic oligonucleotide
cagcacugaaaggaaugaa

SEQ ID NO: 1913 - RNA, 19 nt, Artificial Sequence
  Description of Artificial Sequence: Synthetic oligonucleotide
agcacugaaaggaaugaag

SEQ ID NO: 1914 - RNA, 19 nt, Artificial Sequence
  Description of Artificial Sequence: Synthetic oligonucleotide
gcacugaaaggaaugaagc

SEQ ID NO: 1915 - RNA, 19 nt, Artificial Sequence
  Description of Artificial Sequence: Synthetic oligonucleotide
cacugaaaggaaugaagca

SEQ ID NO: 1916 - RNA, 19 nt, Artificial Sequence
  Description of Artificial Sequence: Synthetic oligonucleotide
acugaaaggaaugaagcac

SEQ ID NO: 1917 - RNA, 19 nt, Artificial Sequence
  Description of Artificial Sequence: Synthetic oligonucleotide
cugaaaggaaugaagcacc

SEQ ID NO: 1918 - RNA, 19 nt, Artificial Sequence
  Description of Artificial Sequence: Synthetic oligonucleotide
ugaaaggaaugaagcacca

SEQ ID NO: 1919 - RNA, 19 nt, Artificial Sequence
  Description of Artificial Sequence: Synthetic oligonucleotide
gaaaggaaugaagcaccag

SEQ ID NO: 1920 - RNA, 19 nt, Artificial Sequence
  Description of Artificial Sequence: Synthetic oligonucleotide
aaaggaaugaagcaccagc

SEQ ID NO: 1921 - RNA, 19 nt, Artificial Sequence
  Description of Artificial Sequence: Synthetic oligonucleotide
aaggaaugaagcaccagca

SEQ ID NO: 1922 - RNA, 19 nt, Artificial Sequence
  Description of Artificial Sequence: Synthetic oligonucleotide
aggaaugaagcaccagcag

SEQ ID NO: 1923 - RNA, 19 nt, Artificial Sequence
  Description of Artificial Sequence: Synthetic oligonucleotide
ggaaugaagcaccagcagg

SEQ ID NO: 1924 - RNA, 19 nt, Artificial Sequence
  Description of Artificial Sequence: Synthetic oligonucleotide
gaaugaagcaccagcagga

SEQ ID NO: 1925 - RNA, 19 nt, Artificial Sequence
  Description of Artificial Sequence: Synthetic oligonucleotide
aaugaagcaccagcaggag

SEQ ID NO: 1926 - RNA, 19 nt, Artificial Sequence
  Description of Artificial Sequence: Synthetic oligonucleotide
augaagcaccagcaggagg

SEQ ID NO: 1927 - RNA, 19 nt, Artificial Sequence
  Description of Artificial Sequence: Synthetic oligonucleotide
ugaagcaccagcaggaggu

SEQ ID NO: 1928 - RNA, 19 nt, Artificial Sequence
  Description of Artificial Sequence: Synthetic oligonucleotide
gaagcaccagcaggaggug

SEQ ID NO: 1929 - RNA, 19 nt, Artificial Sequence
  Description of Artificial Sequence: Synthetic oligonucleotide
aagcaccagcaggaggugg

SEQ ID NO: 1930 - RNA, 19 nt, Artificial Sequence
  Description of Artificial Sequence: Synthetic oligonucleotide
agcaccagcaggaggugga

SEQ ID NO: 1931 - RNA, 19 nt, Artificial Sequence
  Description of Artificial Sequence: Synthetic oligonucleotide
gcaccagcaggagguggac

SEQ ID NO: 1932 - RNA, 19 nt, Artificial Sequence
  Description of Artificial Sequence: Synthetic oligonucleotide
caccagcaggagguggaca

SEQ ID NO: 1933 - RNA, 19 nt, Artificial Sequence
  Description of Artificial Sequence: Synthetic oligonucleotide
accagcaggagguggacag

SEQ ID NO: 1934 - RNA, 19 nt, Artificial Sequence
  Description of Artificial Sequence: Synthetic oligonucleotide
ccagcaggagguggacaga

SEQ ID NO: 1935 - RNA, 19 nt, Artificial Sequence
  Description of Artificial Sequence: Synthetic oligonucleotide
cagcaggagguggacagag

SEQ ID NO: 1936 - RNA, 19 nt, Artificial Sequence
  Description of Artificial Sequence: Synthetic oligonucleotide
agcaggagguggacagagu

SEQ ID NO: 1937 - RNA, 19 nt, Artificial Sequence
  Description of Artificial Sequence: Synthetic oligonucleotide
gcaggagguggacagaguc

SEQ ID NO: 1938 - RNA, 19 nt, Artificial Sequence
  Description of Artificial Sequence: Synthetic oligonucleotide
caggagguggacagagucu

SEQ ID NO: 1939 - RNA, 19 nt, Artificial Sequence
  Description of Artificial Sequence: Synthetic oligonucleotide
aggagguggacagagucuc

SEQ ID NO: 1940 - RNA, 19 nt, Artificial Sequence
  Description of Artificial Sequence: Synthetic oligonucleotide
ggagguggacagagucucu

SEQ ID NO: 1941 - RNA, 19 nt, Artificial Sequence
  Description of Artificial Sequence: Synthetic oligonucleotide
gagguggacagagucucuc

SEQ ID NO: 1942 - RNA, 19 nt, Artificial Sequence
  Description of Artificial Sequence: Synthetic oligonucleotide
agguggacagagucucuca

SEQ ID NO: 1943 - RNA, 19 nt, Artificial Sequence
  Description of Artificial Sequence: Synthetic oligonucleotide
gguggacagagucucucau

SEQ ID NO: 1944 - RNA, 19 nt, Artificial Sequence
  Description of Artificial Sequence: Synthetic oligonucleotide
guggacagagucucucaug

SEQ ID NO: 1945 - RNA, 19 nt, Artificial Sequence
  Description of Artificial Sequence: Synthetic oligonucleotide
uggacagagucucucaugg

SEQ ID NO: 1946 - RNA, 19 nt, Artificial Sequence
  Description of Artificial Sequence: Synthetic oligonucleotide
ggacagagucucucaugga

SEQ ID NO: 1947 - RNA, 19 nt, Artificial Sequence
  Description of Artificial Sequence: Synthetic oligonucleotide
gacagagucucucauggau

SEQ ID NO: 1948 - RNA, 19 nt, Artificial Sequence
  Description of Artificial Sequence: Synthetic oligonucleotide
acagagucucucauggaug

SEQ ID NO: 1949 - RNA, 19 nt, Artificial Sequence
  Description of Artificial Sequence: Synthetic oligonucleotide
cagagucucucauggaugc

SEQ ID NO: 1950 - RNA, 19 nt, Artificial Sequence
  Description of Artificial Sequence: Synthetic oligonucleotide
agagucucucauggaugcc

SEQ ID NO: 1951 - RNA, 19 nt, Artificial Sequence
  Description of Artificial Sequence: Synthetic oligonucleotide
gagucucucauggaugccg

SEQ ID NO: 1952 - RNA, 19 nt, Artificial Sequence
  Description of Artificial Sequence: Synthetic oligonucleotide
agucucucauggaugccgg

SEQ ID NO: 1953 - RNA, 19 nt, Artificial Sequence
  Description of Artificial Sequence: Synthetic oligonucleotide
gucucucauggaugccggc

SEQ ID NO: 1954 - RNA, 19 nt, Artificial Sequence
  Description of Artificial Sequence: Synthetic oligonucleotide
ucucucauggaugccggca

SEQ ID NO: 1955 - RNA, 19 nt, Artificial Sequence
  Description of Artificial Sequence: Synthetic oligonucleotide
cucucauggaugccggcac

SEQ ID NO: 1956 - RNA, 19 nt, Artificial Sequence
  Description of Artificial Sequence: Synthetic oligonucleotide
ucucauggaugccggcaca

SEQ ID NO: 1957 - RNA, 19 nt, Artificial Sequence
  Description of Artificial Sequence: Synthetic oligonucleotide
cucauggaugccggcacaa

SEQ ID NO: 1958 - RNA, 19 nt, Artificial Sequence
  Description of Artificial Sequence: Synthetic oligonucleotide
ucauggaugccggcacaaa

SEQ ID NO: 1959 - RNA, 19 nt, Artificial Sequence
  Description of Artificial Sequence: Synthetic oligonucleotide
cauggaugccggcacaaaa

SEQ ID NO: 1960 - RNA, 19 nt, Artificial Sequence
  Description of Artificial Sequence: Synthetic oligonucleotide
auggaugccggcacaaaac

SEQ ID NO: 1961 - RNA, 19 nt, Artificial Sequence
  Description of Artificial Sequence: Synthetic oligonucleotide
uggaugccggcacaaaacu

SEQ ID NO: 1962 - RNA, 19 nt, Artificial Sequence
  Description of Artificial Sequence: Synthetic oligonucleotide
ggaugccggcacaaaacug

SEQ ID NO: 1963 - RNA, 19 nt, Artificial Sequence
  Description of Artificial Sequence: Synthetic oligonucleotide
gaugccggcacaaaacugc

SEQ ID NO: 1964 - RNA, 19 nt, Artificial Sequence
  Description of Artificial Sequence: Synthetic oligonucleotide
augccggcacaaaacugcc

SEQ ID NO: 1965 - RNA, 19 nt, Artificial Sequence
  Description of Artificial Sequence: Synthetic oligonucleotide
ugccggcacaaaacugccu

SEQ ID NO: 1966 - RNA, 19 nt, Artificial Sequence
  Description of Artificial Sequence: Synthetic oligonucleotide
gccggcacaaaacugccuu

SEQ ID NO: 1967 - RNA, 19 nt, Artificial Sequence
  Description of Artificial Sequence: Synthetic oligonucleotide
ccggcacaaaacugccuua

SEQ ID NO: 1968 - RNA, 19 nt, Artificial Sequence
  Description of Artificial Sequence: Synthetic oligonucleotide
cggcacaaaacugccuuaa

SEQ ID NO: 1969 - RNA, 19 nt, Artificial Sequence
  Description of Artificial Sequence: Synthetic oligonucleotide
ggcacaaaacugccuuaaa

SEQ ID NO: 1970 - RNA, 19 nt, Artificial Sequence
  Description of Artificial Sequence: Synthetic oligonucleotide
gcacaaaacugccuuaaaa

SEQ ID NO: 1971 - RNA, 19 nt, Artificial Sequence
  Description of Artificial Sequence: Synthetic oligonucleotide
cacaaaacugccuuaaaau

SEQ ID NO: 1972 - RNA, 19 nt, Artificial Sequence
  Description of Artificial Sequence: Synthetic oligonucleotide
acaaaacugccuuaaaaua

SEQ ID NO: 1973 - RNA, 19 nt, Artificial Sequence
  Description of Artificial Sequence: Synthetic oligonucleotide
caaaacugccuuaaaauau

SEQ ID NO: 1974 - RNA, 19 nt, Artificial Sequence
  Description of Artificial Sequence: Synthetic oligonucleotide
aaaacugccuuaaaauauu

SEQ ID NO: 1975 - RNA, 19 nt, Artificial Sequence
  Description of Artificial Sequence: Synthetic oligonucleotide
aaacugccuuaaaauauuc

SEQ ID NO: 1976 - RNA, 19 nt, Artificial Sequence
  Description of Artificial Sequence: Synthetic oligonucleotide
aacugccuuaaaauauuca

SEQ ID NO: 1977 - RNA, 19 nt, Artificial Sequence
  Description of Artificial Sequence: Synthetic oligonucleotide
acugccuuaaaauauucau

SEQ ID NO: 1978 - RNA, 19 nt, Artificial Sequence
  Description of Artificial Sequence: Synthetic oligonucleotide
cugccuuaaaauauucaua

SEQ ID NO: 1979 - RNA, 19 nt, Artificial Sequence
  Description of Artificial Sequence: Synthetic oligonucleotide
ugccuuaaaauauucauag

SEQ ID NO: 1980 - RNA, 19 nt, Artificial Sequence
  Description of Artificial Sequence: Synthetic oligonucleotide
gccuuaaaauauucauagu

SEQ ID NO: 1981 - RNA, 19 nt, Artificial Sequence
  Description of Artificial Sequence: Synthetic oligonucleotide
ccuuaaaauauucauaguu

SEQ ID NO: 1982 - RNA, 19 nt, Artificial Sequence
  Description of Artificial Sequence: Synthetic oligonucleotide
cuuaaaauauucauaguua

SEQ ID NO: 1983 - RNA, 19 nt, Artificial Sequence
  Description of Artificial Sequence: Synthetic oligonucleotide
uuaaaauauucauaguuaa

SEQ ID NO: 1984 - RNA, 19 nt, Artificial Sequence
  Description of Artificial Sequence: Synthetic oligonucleotide
uaaaauauucauaguuaau

SEQ ID NO: 1985 - RNA, 19 nt, Artificial Sequence
  Description of Artificial Sequence: Synthetic oligonucleotide
aaaauauucauaguuaaua

SEQ ID NO: 1986 - RNA, 19 nt, Artificial Sequence
  Description of Artificial Sequence: Synthetic oligonucleotide
aaauauucauaguuaauac

SEQ ID NO: 1987 - RNA, 19 nt, Artificial Sequence
  Description of Artificial Sequence: Synthetic oligonucleotide
aauauucauaguuaauaca

SEQ ID NO: 1988 - RNA, 19 nt, Artificial Sequence
  Description of Artificial Sequence: Synthetic oligonucleotide
auauucauaguuaauacag

SEQ ID NO: 1989 - RNA, 19 nt, Artificial Sequence
  Description of Artificial Sequence: Synthetic oligonucleotide
uauucauaguuaauacagg

SEQ ID NO: 1990 - RNA, 19 nt, Artificial Sequence
  Description of Artificial Sequence: Synthetic oligonucleotide
auucauaguuaauacaggu

SEQ ID NO: 1991 - RNA, 19 nt, Artificial Sequence
  Description of Artificial Sequence: Synthetic oligonucleotide
uucauaguuaauacaggua

SEQ ID NO: 1992 - RNA, 19 nt, Artificial Sequence
  Description of Artificial Sequence: Synthetic oligonucleotide
ucauaguuaauacagguau

SEQ ID NO: 1993 - RNA, 19 nt, Artificial Sequence
  Description of Artificial Sequence: Synthetic oligonucleotide
cauaguuaauacagguaua

SEQ ID NO: 1994 - RNA, 19 nt, Artificial Sequence
  Description of Artificial Sequence: Synthetic oligonucleotide
auaguuaauacagguauau

SEQ ID NO: 1995 - RNA, 19 nt, Artificial Sequence
  Description of Artificial Sequence: Synthetic oligonucleotide
uaguuaauacagguauauc

SEQ ID NO: 1996 - RNA, 19 nt, Artificial Sequence
  Description of Artificial Sequence: Synthetic oligonucleotide
aguuaauacagguauaucu

SEQ ID NO: 1997 - RNA, 19 nt, Artificial Sequence
  Description of Artificial Sequence: Synthetic oligonucleotide
guuaauacagguauaucua

SEQ ID NO: 1998 - RNA, 19 nt, Artificial Sequence
  Description of Artificial Sequence: Synthetic oligonucleotide
uuaauacagguauaucuau

SEQ ID NO: 1999 - RNA, 19 nt, Artificial Sequence
  Description of Artificial Sequence: Synthetic oligonucleotide
uaauacagguauaucuauu

SEQ ID NO: 2000 - RNA, 19 nt, Artificial Sequence
  Description of Artificial Sequence: Synthetic oligonucleotide
aauacagguauaucuauuu

SEQ ID NO: 2001 - RNA, 19 nt, Artificial Sequence
  Description of Artificial Sequence: Synthetic oligonucleotide
auacagguauaucuauuuu

SEQ ID NO: 2002 - RNA, 19 nt, Artificial Sequence
  Description of Artificial Sequence: Synthetic oligonucleotide
uacagguauaucuauuuuu

SEQ ID NO: 2003 - RNA, 19 nt, Artificial Sequence
  Description of Artificial Sequence: Synthetic oligonucleotide
acagguauaucuauuuuua

SEQ ID NO: 2004 - RNA, 19 nt, Artificial Sequence
  Description of Artificial Sequence: Synthetic oligonucleotide
cagguauaucuauuuuuau

SEQ ID NO: 2005 - RNA, 19 nt, Artificial Sequence
  Description of Artificial Sequence: Synthetic oligonucleotide
agguauaucuauuuuuauu

SEQ ID NO: 2006 - RNA, 19 nt, Artificial Sequence
  Description of Artificial Sequence: Synthetic oligonucleotide
gguauaucuauuuuuauuu

SEQ ID NO: 2007 - RNA, 19 nt, Artificial Sequence
  Description of Artificial Sequence: Synthetic oligonucleotide
guauaucuauuuuuauuua

SEQ ID NO: 2008 - RNA, 19 nt, Artificial Sequence
  Description of Artificial Sequence: Synthetic oligonucleotide
uauaucuauuuuuauuuac

SEQ ID NO: 2009 - RNA, 19 nt, Artificial Sequence
  Description of Artificial Sequence: Synthetic oligonucleotide
auaucuauuuuuauuuacu

SEQ ID NO: 2010 - RNA, 19 nt, Artificial Sequence
  Description of Artificial Sequence: Synthetic oligonucleotide
uaucuauuuuuauuuacuu

SEQ ID NO: 2011 - RNA, 19 nt, Artificial Sequence
  Description of Artificial Sequence: Synthetic oligonucleotide
aucuauuuuuauuuacuuu

SEQ ID NO: 2012 - RNA, 19 nt, Artificial Sequence
  Description of Artificial Sequence: Synthetic oligonucleotide
ucuauuuuuauuuacuuug

SEQ ID NO: 2013 - RNA, 19 nt, Artificial Sequence
  Description of Artificial Sequence: Synthetic oligonucleotide
cuauuuuuauuuacuuugu

SEQ ID NO: 2014 - RNA, 19 nt, Artificial Sequence
  Description of Artificial Sequence: Synthetic oligonucleotide
uauuuuuauuuacuuugua

SEQ ID NO: 2015 - RNA, 19 nt, Artificial Sequence
  Description of Artificial Sequence: Synthetic oligonucleotide
auuuuuauuuacuuuguaa

SEQ ID NO: 2016 - RNA, 19 nt, Artificial Sequence
  Description of Artificial Sequence: Synthetic oligonucleotide
uuuuuauuuacuuuguaag

SEQ ID NO: 2017 - RNA, 19 nt, Artificial Sequence
  Description of Artificial Sequence: Synthetic oligonucleotide
uuuuauuuacuuuguaaga

SEQ ID NO: 2018 - RNA, 19 nt, Artificial Sequence
  Description of Artificial Sequence: Synthetic oligonucleotide
uuuauuuacuuuguaagaa

SEQ ID NO: 2019 - RNA, 19 nt, Artificial Sequence
  Description of Artificial Sequence: Synthetic oligonucleotide
uuauuuacuuuguaagaaa

SEQ ID NO: 2020 - RNA, 19 nt, Artificial Sequence
  Description of Artificial Sequence: Synthetic oligonucleotide
uauuuacuuuguaagaaac

SEQ ID NO: 2021 - RNA, 19 nt, Artificial Sequence
  Description of Artificial Sequence: Synthetic oligonucleotide
auuuacuuuguaagaaaca

SEQ ID NO: 2022 - RNA, 19 nt, Artificial Sequence
  Description of Artificial Sequence: Synthetic oligonucleotide
uuuacuuuguaagaaacaa

SEQ ID NO: 2023 - RNA, 19 nt, Artificial Sequence
  Description of Artificial Sequence: Synthetic oligonucleotide
uuacuuuguaagaaacaag

SEQ ID NO: 2024 - RNA, 19 nt, Artificial Sequence
  Description of Artificial Sequence: Synthetic oligonucleotide
uacuuuguaagaaacaagc

SEQ ID NO: 2025 - RNA, 19 nt, Artificial Sequence
  Description of Artificial Sequence: Synthetic oligonucleotide
acuuuguaagaaacaagcu

SEQ ID NO: 2026 - RNA, 19 nt, Artificial Sequence
  Description of Artificial Sequence: Synthetic oligonucleotide
cuuuguaagaaacaagcuc

SEQ ID NO: 2027 - RNA, 19 nt, Artificial Sequence
  Description of Artificial Sequence: Synthetic oligonucleotide
uuuguaagaaacaagcuca

SEQ ID NO: 2028 - RNA, 19 nt, Artificial Sequence
  Description of Artificial Sequence: Synthetic oligonucleotide
uuguaagaaacaagcucaa

SEQ ID NO: 2029 - RNA, 19 nt, Artificial Sequence
  Description of Artificial Sequence: Synthetic oligonucleotide
uguaagaaacaagcucaag

SEQ ID NO: 2030 - RNA, 19 nt, Artificial Sequence
  Description of Artificial Sequence: Synthetic oligonucleotide
guaagaaacaagcucaagg

SEQ ID NO: 2031 - RNA, 19 nt, Artificial Sequence
  Description of Artificial Sequence: Synthetic oligonucleotide
uaagaaacaagcucaagga

SEQ ID NO: 2032 - RNA, 19 nt, Artificial Sequence
  Description of Artificial Sequence: Synthetic oligonucleotide
aagaaacaagcucaaggag

SEQ ID NO: 2033 - RNA, 19 nt, Artificial Sequence
  Description of Artificial Sequence: Synthetic oligonucleotide
agaaacaagcucaaggagc

SEQ ID NO: 2034 - RNA, 19 nt, Artificial Sequence
  Description of Artificial Sequence: Synthetic oligonucleotide
gaaacaagcucaaggagcu

SEQ ID NO: 2035 - RNA, 19 nt, Artificial Sequence
  Description of Artificial Sequence: Synthetic oligonucleotide
aaacaagcucaaggagcuu

SEQ ID NO: 2036 - RNA, 19 nt, Artificial Sequence
  Description of Artificial Sequence: Synthetic oligonucleotide
aacaagcucaaggagcuuc

SEQ ID NO: 2037 - RNA, 19 nt, Artificial Sequence
  Description of Artificial Sequence: Synthetic oligonucleotide
acaagcucaaggagcuucc

SEQ ID NO: 2038 - RNA, 19 nt, Artificial Sequence
  Description of Artificial Sequence: Synthetic oligonucleotide
caagcucaaggagcuuccu

SEQ ID NO: 2039 - RNA, 19 nt, Artificial Sequence
  Description of Artificial Sequence: Synthetic oligonucleotide
aagcucaaggagcuuccuu

SEQ ID NO: 2040 - RNA, 19 nt, Artificial Sequence
  Description of Artificial Sequence: Synthetic oligonucleotide
agcucaaggagcuuccuuu

SEQ ID NO: 2041 - RNA, 19 nt, Artificial Sequence
  Description of Artificial Sequence: Synthetic oligonucleotide
gcucaaggagcuuccuuuu

SEQ ID NO: 2042 - RNA, 19 nt, Artificial Sequence
  Description of Artificial Sequence: Synthetic oligonucleotide
cucaaggagcuuccuuuua

SEQ ID NO: 2043 - RNA, 19 nt, Artificial Sequence
  Description of Artificial Sequence: Synthetic oligonucleotide
ucaaggagcuuccuuuuaa

SEQ ID NO: 2044 - RNA, 19 nt, Artificial Sequence
  Description of Artificial Sequence: Synthetic oligonucleotide
caaggagcuuccuuuuaaa

SEQ ID NO: 2045 - RNA, 19 nt, Artificial Sequence
  Description of Artificial Sequence: Synthetic oligonucleotide
aaggagcuuccuuuuaaau

SEQ ID NO: 2046 - RNA, 19 nt, Artificial Sequence
  Description of Artificial Sequence: Synthetic oligonucleotide
aggagcuuccuuuuaaauu

SEQ ID NO: 2047 - RNA, 19 nt, Artificial Sequence
  Description of Artificial Sequence: Synthetic oligonucleotide
ggagcuuccuuuuaaauuu

SEQ ID NO: 2048 - RNA, 19 nt, Artificial Sequence
  Description of Artificial Sequence: Synthetic oligonucleotide
gagcuuccuuuuaaauuuu

SEQ ID NO: 2049 - RNA, 19 nt, Artificial Sequence
  Description of Artificial Sequence: Synthetic oligonucleotide
agcuuccuuuuaaauuuug

SEQ ID NO: 2050 - RNA, 19 nt, Artificial Sequence
  Description of Artificial Sequence: Synthetic oligonucleotide
gcuuccuuuuaaauuuugu

SEQ ID NO: 2051 - RNA, 19 nt, Artificial Sequence
  Description of Artificial Sequence: Synthetic oligonucleotide
cuuccuuuuaaauuuuguc

SEQ ID NO: 2052 - RNA, 19 nt, Artificial Sequence
  Description of Artificial Sequence: Synthetic oligonucleotide
uuccuuuuaaauuuugucu

SEQ ID NO: 2053 - RNA, 19 nt, Artificial Sequence
  Description of Artificial Sequence: Synthetic oligonucleotide
uccuuuuaaauuuugucug

SEQ ID NO: 2054 - RNA, 19 nt, Artificial Sequence
  Description of Artificial Sequence: Synthetic oligonucleotide
ccuuuuaaauuuugucugu

SEQ ID NO: 2055 - RNA, 19 nt, Artificial Sequence
  Description of Artificial Sequence: Synthetic oligonucleotide
cuuuuaaauuuugucugua

SEQ ID NO: 2056 - RNA, 19 nt, Artificial Sequence
  Description of Artificial Sequence: Synthetic oligonucleotide
uuuuaaauuuugucuguag

SEQ ID NO: 2057 - RNA, 19 nt, Artificial Sequence
  Description of Artificial Sequence: Synthetic oligonucleotide
uuuaaauuuugucuguagg

SEQ ID NO: 2058 - RNA, 19 nt, Artificial Sequence
  Description of Artificial Sequence: Synthetic oligonucleotide
uuaaauuuugucuguagga

SEQ ID NO: 2059 - RNA, 19 nt, Artificial Sequence
  Description of Artificial Sequence: Synthetic oligonucleotide
uaaauuuugucuguaggaa

SEQ ID NO: 2060 - RNA, 19 nt, Artificial Sequence
  Description of Artificial Sequence: Synthetic oligonucleotide
aaauuuugucuguaggaaa

SEQ ID NO: 2061 - RNA, 19 nt, Artificial Sequence
  Description of Artificial Sequence: Synthetic oligonucleotide
aauuuugucuguaggaaau

SEQ ID NO: 2062 - RNA, 19 nt, Artificial Sequence
  Description of Artificial Sequence: Synthetic oligonucleotide
auuuugucuguaggaaaug

SEQ ID NO: 2063 - RNA, 19 nt, Artificial Sequence
  Description of Artificial Sequence: Synthetic oligonucleotide
uuuugucuguaggaaaugg

SEQ ID NO: 2064 - RNA, 19 nt, Artificial Sequence
  Description of Artificial Sequence: Synthetic oligonucleotide
uuugucuguaggaaauggu

SEQ ID NO: 2065 - RNA, 19 nt, Artificial Sequence
  Description of Artificial Sequence: Synthetic oligonucleotide
uugucuguaggaaaugguu

SEQ ID NO: 2066 - RNA, 19 nt, Artificial Sequence
  Description of Artificial Sequence: Synthetic oligonucleotide
ugucuguaggaaaugguug

SEQ ID NO: 2067 - RNA, 19 nt, Artificial Sequence
  Description of Artificial Sequence: Synthetic oligonucleotide
gucuguaggaaaugguuga

SEQ ID NO: 2068 - RNA, 19 nt, Artificial Sequence
  Description of Artificial Sequence: Synthetic oligonucleotide
ucuguaggaaaugguugaa

SEQ ID NO: 2069 - RNA, 19 nt, Artificial Sequence
  Description of Artificial Sequence: Synthetic oligonucleotide
cuguaggaaaugguugaaa

SEQ ID NO: 2070 - RNA, 19 nt, Artificial Sequence
  Description of Artificial Sequence: Synthetic oligonucleotide
uguaggaaaugguugaaaa

SEQ ID NO: 2071 - RNA, 19 nt, Artificial Sequence
  Description of Artificial Sequence: Synthetic oligonucleotide
guaggaaaugguugaaaac

SEQ ID NO: 2072 - RNA, 19 nt, Artificial Sequence
  Description of Artificial Sequence: Synthetic oligonucleotide
uaggaaaugguugaaaacu

SEQ ID NO: 2073 - RNA, 19 nt, Artificial Sequence
  Description of Artificial Sequence: Synthetic oligonucleotide
aggaaaugguugaaaacug

SEQ ID NO: 2074 - RNA, 19 nt, Artificial Sequence
  Description of Artificial Sequence: Synthetic oligonucleotide
ggaaaugguugaaaacuga

SEQ ID NO: 2075 - RNA, 19 nt, Artificial Sequence
  Description of Artificial Sequence: Synthetic oligonucleotide
gaaaugguugaaaacugaa

SEQ ID NO: 2076 - RNA, 19 nt, Artificial Sequence
  Description of Artificial Sequence: Synthetic oligonucleotide
aaaugguugaaaacugaag

SEQ ID NO: 2077 - RNA, 19 nt, Artificial Sequence
  Description of Artificial Sequence: Synthetic oligonucleotide
aaugguugaaaacugaagg

SEQ ID NO: 2078 - RNA, 19 nt, Artificial Sequence
  Description of Artificial Sequence: Synthetic oligonucleotide
augguugaaaacugaaggu

SEQ ID NO: 2079 - RNA, 19 nt, Artificial Sequence
  Description of Artificial Sequence: Synthetic oligonucleotide
ugguugaaaacugaaggua

SEQ ID NO: 2080 - RNA, 19 nt, Artificial Sequence
  Description of Artificial Sequence: Synthetic oligonucleotide
gguugaaaacugaagguag

SEQ ID NO: 2081 - RNA, 19 nt, Artificial Sequence
  Description of Artificial Sequence: Synthetic oligonucleotide
guugaaaacugaagguaga

SEQ ID NO: 2082 - RNA, 19 nt, Artificial Sequence
  Description of Artificial Sequence: Synthetic oligonucleotide
uugaaaacugaagguagau

SEQ ID NO: 2083 - RNA, 19 nt, Artificial Sequence
  Description of Artificial Sequence: Synthetic oligonucleotide
ugaaaacugaagguagaug

SEQ ID NO: 2084 - RNA, 19 nt, Artificial Sequence
  Description of Artificial Sequence: Synthetic oligonucleotide
gaaaacugaagguagaugg

SEQ ID NO: 2085 - RNA, 19 nt, Artificial Sequence
  Description of Artificial Sequence: Synthetic oligonucleotide
aaaacugaagguagauggu

SEQ ID NO: 2086 - RNA, 19 nt, Artificial Sequence
  Description of Artificial Sequence: Synthetic oligonucleotide
aaacugaagguagauggug

SEQ ID NO: 2087 - RNA, 19 nt, Artificial Sequence
  Description of Artificial Sequence: Synthetic oligonucleotide
aacugaagguagauggugu

SEQ ID NO: 2088 - RNA, 19 nt, Artificial Sequence
  Description of Artificial Sequence: Synthetic oligonucleotide
acugaagguagaugguguu

SEQ ID NO: 2089 - RNA, 19 nt, Artificial Sequence
  Description of Artificial Sequence: Synthetic oligonucleotide
cugaagguagaugguguua

SEQ ID NO: 2090 - RNA, 19 nt, Artificial Sequence
  Description of Artificial Sequence: Synthetic oligonucleotide
ugaagguagaugguguuau

SEQ ID NO: 2091 - RNA, 19 nt, Artificial Sequence
  Description of Artificial Sequence: Synthetic oligonucleotide
gaagguagaugguguuaua

SEQ ID NO: 2092 - RNA, 19 nt, Artificial Sequence
  Description of Artificial Sequence: Synthetic oligonucleotide
aagguagaugguguuauag

SEQ ID NO: 2093 - RNA, 19 nt, Artificial Sequence
  Description of Artificial Sequence: Synthetic oligonucleotide
agguagaugguguuauagu

SEQ ID NO: 2094 - RNA, 19 nt, Artificial Sequence
  Description of Artificial Sequence: Synthetic oligonucleotide
gguagaugguguuauaguu

SEQ ID NO: 2095 - RNA, 19 nt, Artificial Sequence
  Description of Artificial Sequence: Synthetic oligonucleotide
guagaugguguuauaguua

SEQ ID NO: 2096 - RNA, 19 nt, Artificial Sequence
  Description of Artificial Sequence: Synthetic oligonucleotide
uagaugguguuauaguuaa

SEQ ID NO: 2097 - RNA, 19 nt, Artificial Sequence
  Description of Artificial Sequence: Synthetic oligonucleotide
agaugguguuauaguuaau

SEQ ID NO: 2098 - RNA, 19 nt, Artificial Sequence
  Description of Artificial Sequence: Synthetic oligonucleotide
gaugguguuauaguuaaua

SEQ ID NO: 2099 - RNA, 19 nt, Artificial Sequence
  Description of Artificial Sequence: Synthetic oligonucleotide
augguguuauaguuaauaa

SEQ ID NO: 2100 - RNA, 19 nt, Artificial Sequence
  Description of Artificial Sequence: Synthetic oligonucleotide
ugguguuauaguuaauaau

SEQ ID NO: 2101 - RNA, 19 nt, Artificial Sequence
  Description of Artificial Sequence: Synthetic oligonucleotide
gguguuauaguuaauaaua

SEQ ID NO: 2102 - RNA, 19 nt, Artificial Sequence
  Description of Artificial Sequence: Synthetic oligonucleotide
guguuauaguuaauaauaa

SEQ ID NO: 2103 - RNA, 19 nt, Artificial Sequence
  Description of Artificial Sequence: Synthetic oligonucleotide
uguuauaguuaauaauaaa

SEQ ID NO: 2104 - RNA, 19 nt, Artificial Sequence
  Description of Artificial Sequence: Synthetic oligonucleotide
guuauaguuaauaauaaau

SEQ ID NO: 2105 - RNA, 19 nt, Artificial Sequence
  Description of Artificial Sequence: Synthetic oligonucleotide
uuauaguuaauaauaaaug

SEQ ID NO: 2106 - RNA, 19 nt, Artificial Sequence
  Description of Artificial Sequence: Synthetic oligonucleotide
uauaguuaauaauaaaugc

SEQ ID NO: 2107 - RNA, 19 nt, Artificial Sequence
  Description of Artificial Sequence: Synthetic oligonucleotide
auaguuaauaauaaaugcu

SEQ ID NO: 2108 - RNA, 19 nt, Artificial Sequence
  Description of Artificial Sequence: Synthetic oligonucleotide
uaguuaauaauaaaugcug

SEQ ID NO: 2109 - RNA, 19 nt, Artificial Sequence
  Description of Artificial Sequence: Synthetic oligonucleotide
aguuaauaauaaaugcugu

SEQ ID NO: 2110 - RNA, 19 nt, Artificial Sequence
  Description of Artificial Sequence: Synthetic oligonucleotide
guuaauaauaaaugcugua

SEQ ID NO: 2111 - RNA, 19 nt, Artificial Sequence
  Description of Artificial Sequence: Synthetic oligonucleotide
uuaauaauaaaugcuguaa

SEQ ID NO: 2112 - RNA, 19 nt, Artificial Sequence
  Description of Artificial Sequence: Synthetic oligonucleotide
uaauaauaaaugcuguaaa

SEQ ID NO: 2113 - RNA, 19 nt, Artificial Sequence
  Description of Artificial Sequence: Synthetic oligonucleotide
aauaauaaaugcuguaaau

SEQ ID NO: 2114 - RNA, 19 nt, Artificial Sequence
  Description of Artificial Sequence: Synthetic oligonucleotide
auaauaaaugcuguaaaua

SEQ ID NO: 2115 - RNA, 19 nt, Artificial Sequence
  Description of Artificial Sequence: Synthetic oligonucleotide
uaauaaaugcuguaaauaa

SEQ ID NO: 2116 - RNA, 19 nt, Artificial Sequence
  Description of Artificial Sequence: Synthetic oligonucleotide
aauaaaugcuguaaauaag

SEQ ID NO: 2117 - RNA, 19 nt, Artificial Sequence
  Description of Artificial Sequence: Synthetic oligonucleotide
auaaaugcuguaaauaagc

SEQ ID NO: 2118 - RNA, 19 nt, Artificial Sequence
  Description of Artificial Sequence: Synthetic oligonucleotide
uaaaugcuguaaauaagca

SEQ ID NO: 2119 - RNA, 19 nt, Artificial Sequence
  Description of Artificial Sequence: Synthetic oligonucleotide
aaaugcuguaaauaagcau

SEQ ID NO: 2120 - RNA, 19 nt, Artificial Sequence
  Description of Artificial Sequence: Synthetic oligonucleotide
aaugcuguaaauaagcauc

SEQ ID NO: 2121 - RNA, 19 nt, Artificial Sequence
  Description of Artificial Sequence: Synthetic oligonucleotide
augcuguaaauaagcaucu

SEQ ID NO: 2122 - RNA, 19 nt, Artificial Sequence
  Description of Artificial Sequence: Synthetic oligonucleotide
ugcuguaaauaagcaucuc

SEQ ID NO: 2123 - RNA, 19 nt, Artificial Sequence
  Description of Artificial Sequence: Synthetic oligonucleotide
gcuguaaauaagcaucuca

SEQ ID NO: 2124 - RNA, 19 nt, Artificial Sequence
  Description of Artificial Sequence: Synthetic oligonucleotide
cuguaaauaagcaucucac

SEQ ID NO: 2125 - RNA, 19 nt, Artificial Sequence
  Description of Artificial Sequence: Synthetic oligonucleotide
uguaaauaagcaucucacu

SEQ ID NO: 2126 - RNA, 19 nt, Artificial Sequence
  Description of Artificial Sequence: Synthetic oligonucleotide
guaaauaagcaucucacuu

SEQ ID NO: 2127 - RNA, 19 nt, Artificial Sequence
  Description of Artificial Sequence: Synthetic oligonucleotide
uaaauaagcaucucacuuu

SEQ ID NO: 2128 - RNA, 19 nt, Artificial Sequence
  Description of Artificial Sequence: Synthetic oligonucleotide
aaauaagcaucucacuuug

SEQ ID NO: 2129 - RNA, 19 nt, Artificial Sequence
  Description of Artificial Sequence: Synthetic oligonucleotide
aauaagcaucucacuuugu

SEQ ID NO: 2130 - RNA, 19 nt, Artificial Sequence
  Description of Artificial Sequence: Synthetic oligonucleotide
auaagcaucucacuuugua

SEQ ID NO: 2131 - RNA, 19 nt, Artificial Sequence
  Description of Artificial Sequence: Synthetic oligonucleotide
uaagcaucucacuuuguaa

SEQ ID NO: 2132 - RNA, 19 nt, Artificial Sequence
  Description of Artificial Sequence: Synthetic oligonucleotide
aagcaucucacuuuguaaa

SEQ ID NO: 2133 - RNA, 19 nt, Artificial Sequence
  Description of Artificial Sequence: Synthetic oligonucleotide
agcaucucacuuuguaaaa

SEQ ID NO: 2134 - RNA, 19 nt, Artificial Sequence
  Description of Artificial Sequence: Synthetic oligonucleotide
gcaucucacuuuguaaaaa

SEQ ID NO: 2135 - RNA, 19 nt, Artificial Sequence
  Description of Artificial Sequence: Synthetic oligonucleotide
caucucacuuuguaaaaau

SEQ ID NO: 2136 - RNA, 19 nt, Artificial Sequence
  Description of Artificial Sequence: Synthetic oligonucleotide
aucucacuuuguaaaaaua

SEQ ID NO: 2137 - RNA, 19 nt, Artificial Sequence
  Description of Artificial Sequence: Synthetic oligonucleotide
ucucacuuuguaaaaauaa

SEQ ID NO: 2138 - RNA, 19 nt, Artificial Sequence
  Description of Artificial Sequence: Synthetic oligonucleotide
cucacuuuguaaaaauaaa

SEQ ID NO: 2139 - RNA, 19 nt, Artificial Sequence
  Description of Artificial Sequence: Synthetic oligonucleotide
ucacuuuguaaaaauaaaa

SEQ ID NO: 2140 - RNA, 19 nt, Artificial Sequence
  Description of Artificial Sequence: Synthetic oligonucleotide
cacuuuguaaaaauaaaau

SEQ ID NO: 2141 - RNA, 19 nt, Artificial Sequence
  Description of Artificial Sequence: Synthetic oligonucleotide
acuuuguaaaaauaaaaua

SEQ ID NO: 2142 - RNA, 19 nt, Artificial Sequence
  Description of Artificial Sequence: Synthetic oligonucleotide
cuuuguaaaaauaaaauau

SEQ ID NO: 2143 - RNA, 19 nt, Artificial Sequence
  Description of Artificial Sequence: Synthetic oligonucleotide
uuuguaaaaauaaaauauu

SEQ ID NO: 2144 - RNA, 19 nt, Artificial Sequence
  Description of Artificial Sequence: Synthetic oligonucleotide
uuguaaaaauaaaauauug

SEQ ID NO: 2145 - RNA, 19 nt, Artificial Sequence
  Description of Artificial Sequence: Synthetic oligonucleotide
uguaaaaauaaaauauugu

SEQ ID NO: 2146 - RNA, 19 nt, Artificial Sequence
  Description of Artificial Sequence: Synthetic oligonucleotide
guaaaaauaaaauauugug

SEQ ID NO: 2147 - RNA, 19 nt, Artificial Sequence
  Description of Artificial Sequence: Synthetic oligonucleotide
uaaaaauaaaauauugugg

SEQ ID NO: 2148 - RNA, 19 nt, Artificial Sequence
  Description of Artificial Sequence: Synthetic oligonucleotide
aaaaauaaaauauuguggu

SEQ ID NO: 2149 - RNA, 19 nt, Artificial Sequence
  Description of Artificial Sequence: Synthetic oligonucleotide
aaaauaaaauauugugguu

SEQ ID NO: 2150 - RNA, 19 nt, Artificial Sequence
  Description of Artificial Sequence: Synthetic oligonucleotide
aaauaaaauauugugguuu

SEQ ID NO: 2151 - RNA, 19 nt, Artificial Sequence
  Description of Artificial Sequence: Synthetic oligonucleotide
aauaaaauauugugguuuu

SEQ ID NO: 2152 - RNA, 19 nt, Artificial Sequence
  Description of Artificial Sequence: Synthetic oligonucleotide
auaaaauauugugguuuug

SEQ ID NO: 2153 - RNA, 19 nt, Artificial Sequence
  Description of Artificial Sequence: Synthetic oligonucleotide
uaaaauauugugguuuugu

SEQ ID NO: 2154 - RNA, 19 nt, Artificial Sequence
  Description of Artificial Sequence: Synthetic oligonucleotide
aaaauauugugguuuuguu

SEQ ID NO: 2155 - RNA, 19 nt, Artificial Sequence
  Description of Artificial Sequence: Synthetic oligonucleotide
aaauauugugguuuuguuu

SEQ ID NO: 2156 - RNA, 19 nt, Artificial Sequence
  Description of Artificial Sequence: Synthetic oligonucleotide
aauauugugguuuuguuuu

SEQ ID NO: 2157 - RNA, 19 nt, Artificial Sequence
  Description of Artificial Sequence: Synthetic oligonucleotide
auauugugguuuuguuuua

SEQ ID NO: 2158 - RNA, 19 nt, Artificial Sequence
  Description of Artificial Sequence: Synthetic oligonucleotide
uauugugguuuuguuuuaa

SEQ ID NO: 2159 - RNA, 19 nt, Artificial Sequence
  Description of Artificial Sequence: Synthetic oligonucleotide
auugugguuuuguuuuaaa

SEQ ID NO: 2160 - RNA, 19 nt, Artificial Sequence
  Description of Artificial Sequence: Synthetic oligonucleotide
uugugguuuuguuuuaaac

SEQ ID NO: 2161 - RNA, 19 nt, Artificial Sequence
  Description of Artificial Sequence: Synthetic oligonucleotide
ugugguuuuguuuuaaaca

SEQ ID NO: 2162 - RNA, 19 nt, Artificial Sequence
  Description of Artificial Sequence: Synthetic oligonucleotide
gugguuuuguuuuaaacau

SEQ ID NO: 2163 - RNA, 19 nt, Artificial Sequence
  Description of Artificial Sequence: Synthetic oligonucleotide
ugguuuuguuuuaaacauu

SEQ ID NO: 2164 - RNA, 19 nt, Artificial Sequence
  Description of Artificial Sequence: Synthetic oligonucleotide
gguuuuguuuuaaacauuc

SEQ ID NO: 2165 - RNA, 19 nt, Artificial Sequence
  Description of Artificial Sequence: Synthetic oligonucleotide
guuuuguuuuaaacauuca

SEQ ID NO: 2166 - RNA, 19 nt, Artificial Sequence
  Description of Artificial Sequence: Synthetic oligonucleotide
uuuuguuuuaaacauucaa

SEQ ID NO: 2167 - RNA, 19 nt, Artificial Sequence
  Description of Artificial Sequence: Synthetic oligonucleotide
uuuguuuuaaacauucaac

SEQ ID NO: 2168 - RNA, 19 nt, Artificial Sequence
  Description of Artificial Sequence: Synthetic oligonucleotide
uuguuuuaaacauucaacg

SEQ ID NO: 2169 - RNA, 19 nt, Artificial Sequence
  Description of Artificial Sequence: Synthetic oligonucleotide
uguuuuaaacauucaacgu

SEQ ID NO: 2170 - RNA, 19 nt, Artificial Sequence
  Description of Artificial Sequence: Synthetic oligonucleotide
guuuuaaacauucaacguu

SEQ ID NO: 2171 - RNA, 19 nt, Artificial Sequence
  Description of Artificial Sequence: Synthetic oligonucleotide
uuuuaaacauucaacguuu

SEQ ID NO: 2172 - RNA, 19 nt, Artificial Sequence
  Description of Artificial Sequence: Synthetic oligonucleotide
uuuaaacauucaacguuuc

SEQ ID NO: 2173 - RNA, 19 nt, Artificial Sequence
  Description of Artificial Sequence: Synthetic oligonucleotide
uuaaacauucaacguuucu

SEQ ID NO: 2174 - RNA, 19 nt, Artificial Sequence
  Description of Artificial Sequence: Synthetic oligonucleotide
uaaacauucaacguuucuu

SEQ ID NO: 2175 - RNA, 19 nt, Artificial Sequence
  Description of Artificial Sequence: Synthetic oligonucleotide
aaacauucaacguuucuuu

SEQ ID NO: 2176 - RNA, 19 nt, Artificial Sequence
  Description of Artificial Sequence: Synthetic oligonucleotide
aacauucaacguuucuuuu

SEQ ID NO: 2177 - RNA, 19 nt, Artificial Sequence
  Description of Artificial Sequence: Synthetic oligonucleotide
acauucaacguuucuuuuc

SEQ ID NO: 2178 - RNA, 19 nt, Artificial Sequence
  Description of Artificial Sequence: Synthetic oligonucleotide
cauucaacguuucuuuucc

SEQ ID NO: 2179 - RNA, 19 nt, Artificial Sequence
  Description of Artificial Sequence: Synthetic oligonucleotide
auucaacguuucuuuuccu

SEQ ID NO: 2180 - RNA, 19 nt, Artificial Sequence
  Description of Artificial Sequence: Synthetic oligonucleotide
uucaacguuucuuuuccuu

SEQ ID NO: 2181 - RNA, 19 nt, Artificial Sequence
  Description of Artificial Sequence: Synthetic oligonucleotide
ucaacguuucuuuuccuuc

SEQ ID NO: 2182 - RNA, 19 nt, Artificial Sequence
  Description of Artificial Sequence: Synthetic oligonucleotide
caacguuucuuuuccuucu

SEQ ID NO: 2183 - RNA, 19 nt, Artificial Sequence
  Description of Artificial Sequence: Synthetic oligonucleotide
aacguuucuuuuccuucua

SEQ ID NO: 2184 - RNA, 19 nt, Artificial Sequence
  Description of Artificial Sequence: Synthetic oligonucleotide
acguuucuuuuccuucuac

SEQ ID NO: 2185 - RNA, 19 nt, Artificial Sequence
  Description of Artificial Sequence: Synthetic oligonucleotide
cguuucuuuuccuucuaca

SEQ ID NO: 2186 - RNA, 19 nt, Artificial Sequence
  Description of Artificial Sequence: Synthetic oligonucleotide
guuucuuuuccuucuacaa

SEQ ID NO: 2187 - RNA, 19 nt, Artificial Sequence
  Description of Artificial Sequence: Synthetic oligonucleotide
uuucuuuuccuucuacaau

SEQ ID NO: 2188 - RNA, 19 nt, Artificial Sequence
  Description of Artificial Sequence: Synthetic oligonucleotide
uucuuuuccuucuacaaua

SEQ ID NO: 2189 - RNA, 19 nt, Artificial Sequence
  Description of Artificial Sequence: Synthetic oligonucleotide
ucuuuuccuucuacaauaa

SEQ ID NO: 2190 - RNA, 19 nt, Artificial Sequence
  Description of Artificial Sequence: Synthetic oligonucleotide
cuuuuccuucuacaauaaa

SEQ ID NO: 2191 - RNA, 19 nt, Artificial Sequence
  Description of Artificial Sequence: Synthetic oligonucleotide
uuuuccuucuacaauaaac

SEQ ID NO: 2192 - RNA, 19 nt, Artificial Sequence
  Description of Artificial Sequence: Synthetic oligonucleotide
uuuccuucuacaauaaaca

SEQ ID NO: 2193 - RNA, 19 nt, Artificial Sequence
  Description of Artificial Sequence: Synthetic oligonucleotide
uuccuucuacaauaaacac

SEQ ID NO: 2194 - RNA, 19 nt, Artificial Sequence
  Description of Artificial Sequence: Synthetic oligonucleotide
uccuucuacaauaaacacu

SEQ ID NO: 2195 - RNA, 19 nt, Artificial Sequence
  Description of Artificial Sequence: Synthetic oligonucleotide
ccuucuacaauaaacacuu

SEQ ID NO: 2196 - RNA, 19 nt, Artificial Sequence
  Description of Artificial Sequence: Synthetic oligonucleotide
cuucuacaauaaacacuuu

SEQ ID NO: 2197 - RNA, 19 nt, Artificial Sequence
  Description of Artificial Sequence: Synthetic oligonucleotide
uucuacaauaaacacuuuc

SEQ ID NO: 2198 - RNA, 19 nt, Artificial Sequence
  Description of Artificial Sequence: Synthetic oligonucleotide
ucuacaauaaacacuuuca

SEQ ID NO: 2199 - RNA, 19 nt, Artificial Sequence
  Description of Artificial Sequence: Synthetic oligonucleotide
cuacaauaaacacuuucaa

SEQ ID NO: 2200 - RNA, 19 nt, Artificial Sequence
  Description of Artificial Sequence: Synthetic oligonucleotide
uacaauaaacacuuucaaa

SEQ ID NO: 2201 - RNA, 19 nt, Artificial Sequence
  Description of Artificial Sequence: Synthetic oligonucleotide
acaauaaacacuuucaaaa

SEQ ID NO: 2202 - RNA, 19 nt, Artificial Sequence
  Description of Artificial Sequence: Synthetic oligonucleotide
caauaaacacuuucaaaau

SEQ ID NO: 2203 - RNA, 19 nt, Artificial Sequence
  Description of Artificial Sequence: Synthetic oligonucleotide
aauaaacacuuucaaaaug

SEQ ID NO: 2204 - RNA, 19 nt, Artificial Sequence
  Description of Artificial Sequence: Synthetic oligonucleotide
auaaacacuuucaaaaugu

SEQ ID NO: 2205 - RNA, 19 nt, Artificial Sequence
  Description of Artificial Sequence: Synthetic oligonucleotide
uaaacacuuucaaaaugug

SEQ ID NO: 2206 - RNA, 19 nt, Artificial Sequence
  Description of Artificial Sequence: Synthetic oligonucleotide
aaacacuuucaaaauguga

SEQ ID NO: 2207 - RNA, 19 nt, Artificial Sequence
  Description of Artificial Sequence: Synthetic oligonucleotide
uagcuuuccuuccaagccc

SEQ ID NO: 2208 - RNA, 19 nt, Artificial Sequence
  Description of Artificial Sequence: Synthetic oligonucleotide
auagcuuuccuuccaagcc

SEQ ID NO: 2209 - RNA, 19 nt, Artificial Sequence
  Description of Artificial Sequence: Synthetic oligonucleotide
uauagcuuuccuuccaagc

SEQ ID NO: 2210 - RNA, 19 nt, Artificial Sequence
  Description of Artificial Sequence: Synthetic oligonucleotide
cuauagcuuuccuuccaag

SEQ ID NO: 2211 - RNA, 19 nt, Artificial Sequence
  Description of Artificial Sequence: Synthetic oligonucleotide
ccuauagcuuuccuuccaa

SEQ ID NO: 2212 - RNA, 19 nt, Artificial Sequence
  Description of Artificial Sequence: Synthetic oligonucleotide
gccuauagcuuuccuucca

SEQ ID NO: 2213 - RNA, 19 nt, Artificial Sequence
  Description of Artificial Sequence: Synthetic oligonucleotide
agccuauagcuuuccuucc

SEQ ID NO: 2214 - RNA, 19 nt, Artificial Sequence
  Description of Artificial Sequence: Synthetic oligonucleotide
uagccuauagcuuuccuuc

SEQ ID NO: 2215 - RNA, 19 nt, Artificial Sequence
  Description of Artificial Sequence: Synthetic oligonucleotide
guagccuauagcuuuccuu

SEQ ID NO: 2216 - RNA, 19 nt, Artificial Sequence
  Description of Artificial Sequence: Synthetic oligonucleotide
gguagccuauagcuuuccu

SEQ ID NO: 2217 - RNA, 19 nt, Artificial Sequence
  Description of Artificial Sequence: Synthetic oligonucleotide
ggguagccuauagcuuucc

SEQ ID NO: 2218 - RNA, 19 nt, Artificial Sequence
  Description of Artificial Sequence: Synthetic oligonucleotide
uggguagccuauagcuuuc

SEQ ID NO: 2219 - RNA, 19 nt, Artificial Sequence
  Description of Artificial Sequence: Synthetic oligonucleotide
auggguagccuauagcuuu

SEQ ID NO: 2220 - RNA, 19 nt, Artificial Sequence
  Description of Artificial Sequence: Synthetic oligonucleotide
aauggguagccuauagcuu

SEQ ID NO: 2221 - RNA, 19 nt, Artificial Sequence
  Description of Artificial Sequence: Synthetic oligonucleotide
gaauggguagccuauagcu

SEQ ID NO: 2222 - RNA, 19 nt, Artificial Sequence
  Description of Artificial Sequence: Synthetic oligonucleotide
ugaauggguagccuauagc

SEQ ID NO: 2223 - RNA, 19 nt, Artificial Sequence
  Description of Artificial Sequence: Synthetic oligonucleotide
cugaauggguagccuauag

SEQ ID NO: 2224 - RNA, 19 nt, Artificial Sequence
  Description of Artificial Sequence: Synthetic oligonucleotide
gcugaauggguagccuaua

SEQ ID NO: 2225 - RNA, 19 nt, Artificial Sequence
  Description of Artificial Sequence: Synthetic oligonucleotide
agcugaauggguagccuau

SEQ ID NO: 2226 - RNA, 19 nt, Artificial Sequence
  Description of Artificial Sequence: Synthetic oligonucleotide
gagcugaauggguagccua

SEQ ID NO: 2227 - RNA, 19 nt, Artificial Sequence
  Description of Artificial Sequence: Synthetic oligonucleotide
ggagcugaauggguagccu

SEQ ID NO: 2228 - RNA, 19 nt, Artificial Sequence
  Description of Artificial Sequence: Synthetic oligonucleotide
gggagcugaauggguagcc

SEQ ID NO: 2229 - RNA, 19 nt, Artificial Sequence
  Description of Artificial Sequence: Synthetic oligonucleotide
ggggagcugaauggguagc

SEQ ID NO: 2230 - RNA, 19 nt, Artificial Sequence
  Description of Artificial Sequence: Synthetic oligonucleotide
aggggagcugaauggguag

SEQ ID NO: 2231 - RNA, 19 nt, Artificial Sequence
  Description of Artificial Sequence: Synthetic oligonucleotide
caggggagcugaaugggua

SEQ ID NO: 2232 - RNA, 19 nt, Artificial Sequence
  Description of Artificial Sequence: Synthetic oligonucleotide
acaggggagcugaaugggu

SEQ ID NO: 2233 - RNA, 19 nt, Artificial Sequence
  Description of Artificial Sequence: Synthetic oligonucleotide
gacaggggagcugaauggg

SEQ ID NO: 2234 - RNA, 19 nt, Artificial Sequence
  Description of Artificial Sequence: Synthetic oligonucleotide
ugacaggggagcugaaugg

SEQ ID NO: 2235 - RNA, 19 nt, Artificial Sequence
  Description of Artificial Sequence: Synthetic oligonucleotide
cugacaggggagcugaaug

SEQ ID NO: 2236 - RNA, 19 nt, Artificial Sequence
  Description of Artificial Sequence: Synthetic oligonucleotide
ucugacaggggagcugaau

SEQ ID NO: 2237 - RNA, 19 nt, Artificial Sequence
  Description of Artificial Sequence: Synthetic oligonucleotide
cucugacaggggagcugaa

SEQ ID NO: 2238 - RNA, 19 nt, Artificial Sequence
  Description of Artificial Sequence: Synthetic oligonucleotide
ucucugacaggggagcuga

SEQ ID NO: 2239 - RNA, 19 nt, Artificial Sequence
  Description of Artificial Sequence: Synthetic oligonucleotide
gucucugacaggggagcug

SEQ ID NO: 2240 - RNA, 19 nt, Artificial Sequence
  Description of Artificial Sequence: Synthetic oligonucleotide
agucucugacaggggagcu

SEQ ID NO: 2241 - RNA, 19 nt, Artificial Sequence
  Description of Artificial Sequence: Synthetic oligonucleotide
gagucucugacaggggagc

SEQ ID NO: 2242 - RNA, 19 nt, Artificial Sequence
  Description of Artificial Sequence: Synthetic oligonucleotide
ugagucucugacaggggag

SEQ ID NO: 2243 - RNA, 19 nt, Artificial Sequence
  Description of Artificial Sequence: Synthetic oligonucleotide
uugagucucugacagggga

SEQ ID NO: 2244 - RNA, 19 nt, Artificial Sequence
  Description of Artificial Sequence: Synthetic oligonucleotide
cuugagucucugacagggg

SEQ ID NO: 2245 - RNA, 19 nt, Artificial Sequence
  Description of Artificial Sequence: Synthetic oligonucleotide
gcuugagucucugacaggg

SEQ ID NO: 2246 - RNA, 19 nt, Artificial Sequence
  Description of Artificial Sequence: Synthetic oligonucleotide
agcuugagucucugacagg

SEQ ID NO: 2247 - RNA, 19 nt, Artificial Sequence
  Description of Artificial Sequence: Synthetic oligonucleotide
aagcuugagucucugacag

SEQ ID NO: 2248 - RNA, 19 nt, Artificial Sequence
  Description of Artificial Sequence: Synthetic oligonucleotide
aaagcuugagucucugaca

SEQ ID NO: 2249 - RNA, 19 nt, Artificial Sequence
  Description of Artificial Sequence: Synthetic oligonucleotide
caaagcuugagucucugac

SEQ ID NO: 2250 - RNA, 19 nt, Artificial Sequence
  Description of Artificial Sequence: Synthetic oligonucleotide
ucaaagcuugagucucuga

SEQ ID NO: 2251 - RNA, 19 nt, Artificial Sequence
  Description of Artificial Sequence: Synthetic oligonucleotide
cucaaagcuugagucucug

SEQ ID NO: 2252 - RNA, 19 nt, Artificial Sequence
  Description of Artificial Sequence: Synthetic oligonucleotide
ucucaaagcuugagucucu

SEQ ID NO: 2253 - RNA, 19 nt, Artificial Sequence
  Description of Artificial Sequence: Synthetic oligonucleotide
uucucaaagcuugagucuc

SEQ ID NO: 2254 - RNA, 19 nt, Artificial Sequence
  Description of Artificial Sequence: Synthetic oligonucleotide
uuucucaaagcuugagucu

SEQ ID NO: 2255 - RNA, 19 nt, Artificial Sequence
  Description of Artificial Sequence: Synthetic oligonucleotide
cuuucucaaagcuugaguc

SEQ ID NO: 2256 - RNA, 19 nt, Artificial Sequence
  Description of Artificial Sequence: Synthetic oligonucleotide
ccuuucucaaagcuugagu

SEQ ID NO: 2257 - RNA, 19 nt, Artificial Sequence
  Description of Artificial Sequence: Synthetic oligonucleotide
gccuuucucaaagcuugag

SEQ ID NO: 2258 - RNA, 19 nt, Artificial Sequence
  Description of Artificial Sequence: Synthetic oligonucleotide
agccuuucucaaagcuuga

SEQ ID NO: 2259 - RNA, 19 nt, Artificial Sequence
  Description of Artificial Sequence: Synthetic oligonucleotide
uagccuuucucaaagcuug

SEQ ID NO: 2260 - RNA, 19 nt, Artificial Sequence
  Description of Artificial Sequence: Synthetic oligonucleotide
cuagccuuucucaaagcuu

SEQ ID NO: 2261 - RNA, 19 nt, Artificial Sequence
  Description of Artificial Sequence: Synthetic oligonucleotide
gcuagccuuucucaaagcu

SEQ ID NO: 2262 - RNA, 19 nt, Artificial Sequence
  Description of Artificial Sequence: Synthetic oligonucleotide
ugcuagccuuucucaaagc

SEQ ID NO: 2263 - RNA, 19 nt, Artificial Sequence
  Description of Artificial Sequence: Synthetic oligonucleotide
uugcuagccuuucucaaag

SEQ ID NO: 2264 - RNA, 19 nt, Artificial Sequence
  Description of Artificial Sequence: Synthetic oligonucleotide
uuugcuagccuuucucaaa

SEQ ID NO: 2265 - RNA, 19 nt, Artificial Sequence
  Description of Artificial Sequence: Synthetic oligonucleotide
cuuugcuagccuuucucaa

SEQ ID NO: 2266 - RNA, 19 nt, Artificial Sequence
  Description of Artificial Sequence: Synthetic oligonucleotide
ucuuugcuagccuuucuca

SEQ ID NO: 2267 - RNA, 19 nt, Artificial Sequence
  Description of Artificial Sequence: Synthetic oligonucleotide
cucuuugcuagccuuucuc

SEQ ID NO: 2268 - RNA, 19 nt, Artificial Sequence
  Description of Artificial Sequence: Synthetic oligonucleotide
gcucuuugcuagccuuucu

SEQ ID NO: 2269 - RNA, 19 nt, Artificial Sequence
  Description of Artificial Sequence: Synthetic oligonucleotide
ugcucuuugcuagccuuuc

SEQ ID NO: 2270 - RNA, 19 nt, Artificial Sequence
  Description of Artificial Sequence: Synthetic oligonucleotide
uugcucuuugcuagccuuu

SEQ ID NO: 2271 - RNA, 19 nt, Artificial Sequence
  Description of Artificial Sequence: Synthetic oligonucleotide
cuugcucuuugcuagccuu

SEQ ID NO: 2272 - RNA, 19 nt, Artificial Sequence
  Description of Artificial Sequence: Synthetic oligonucleotide
ccuugcucuuugcuagccu

SEQ ID NO: 2273 - RNA, 19 nt, Artificial Sequence
  Description of Artificial Sequence: Synthetic oligonucleotide
uccuugcucuuugcuagcc

SEQ ID NO: 2274 - RNA, 19 nt, Artificial Sequence
  Description of Artificial Sequence: Synthetic oligonucleotide
uuccuugcucuuugcuagc

SEQ ID NO: 2275 - RNA, 19 nt, Artificial Sequence
  Description of Artificial Sequence: Synthetic oligonucleotide
uuuccuugcucuuugcuag

SEQ ID NO: 2276 - RNA, 19 nt, Artificial Sequence
  Description of Artificial Sequence: Synthetic oligonucleotide
cuuuccuugcucuuugcua

SEQ ID NO: 2277 - RNA, 19 nt, Artificial Sequence
  Description of Artificial Sequence: Synthetic oligonucleotide
ucuuuccuugcucuuugcu

SEQ ID NO: 2278 - RNA, 19 nt, Artificial Sequence
  Description of Artificial Sequence: Synthetic oligonucleotide
cucuuuccuugcucuuugc

SEQ ID NO: 2279 - RNA, 19 nt, Artificial Sequence
  Description of Artificial Sequence: Synthetic oligonucleotide
ucucuuuccuugcucuuug

SEQ ID NO: 2280 - RNA, 19 nt, Artificial Sequence
  Description of Artificial Sequence: Synthetic oligonucleotide
cucucuuuccuugcucuuu

SEQ ID NO: 2281 - RNA, 19 nt, Artificial Sequence
  Description of Artificial Sequence: Synthetic oligonucleotide
ucucucuuuccuugcucuu

SEQ ID NO: 2282 - RNA, 19 nt, Artificial Sequence
  Description of Artificial Sequence: Synthetic oligonucleotide
uucucucuuuccuugcucu

SEQ ID NO: 2283 - RNA, 19 nt, Artificial Sequence
  Description of Artificial Sequence: Synthetic oligonucleotide
uuucucucuuuccuugcuc

SEQ ID NO: 2284 - RNA, 19 nt, Artificial Sequence
  Description of Artificial Sequence: Synthetic oligonucleotide
uuuucucucuuuccuugcu

SEQ ID NO: 2285 - RNA, 19 nt, Artificial Sequence
  Description of Artificial Sequence: Synthetic oligonucleotide
guuuucucucuuuccuugc

SEQ ID NO: 2286 - RNA, 19 nt, Artificial Sequence
  Description of Artificial Sequence: Synthetic oligonucleotide
uguuuucucucuuuccuug

SEQ ID NO: 2287 - RNA, 19 nt, Artificial Sequence
  Description of Artificial Sequence: Synthetic oligonucleotide
uuguuuucucucuuuccuu

SEQ ID NO: 2288 - RNA, 19 nt, Artificial Sequence
  Description of Artificial Sequence: Synthetic oligonucleotide
guuguuuucucucuuuccu

SEQ ID NO: 2289 - RNA, 19 nt, Artificial Sequence
  Description of Artificial Sequence: Synthetic oligonucleotide
uguuguuuucucucuuucc

SEQ ID NO: 2290 - RNA, 19 nt, Artificial Sequence
  Description of Artificial Sequence: Synthetic oligonucleotide
uuguuguuuucucucuuuc

SEQ ID NO: 2291 - RNA, 19 nt, Artificial Sequence
  Description of Artificial Sequence: Synthetic oligonucleotide
uuuguuguuuucucucuuu

SEQ ID NO: 2292 - RNA, 19 nt, Artificial Sequence
  Description of Artificial Sequence: Synthetic oligonucleotide
cuuuguuguuuucucucuu

SEQ ID NO: 2293 - RNA, 19 nt, Artificial Sequence
  Description of Artificial Sequence: Synthetic oligonucleotide
acuuuguuguuuucucucu

SEQ ID NO: 2294 - RNA, 19 nt, Artificial Sequence
  Description of Artificial Sequence: Synthetic oligonucleotide
cacuuuguuguuuucucuc

SEQ ID NO: 2295 - RNA, 19 nt, Artificial Sequence
  Description of Artificial Sequence: Synthetic oligonucleotide
ccacuuuguuguuuucucu

SEQ ID NO: 2296 - RNA, 19 nt, Artificial Sequence
  Description of Artificial Sequence: Synthetic oligonucleotide
gccacuuuguuguuuucuc

SEQ ID NO: 2297 - RNA, 19 nt, Artificial Sequence
  Description of Artificial Sequence: Synthetic oligonucleotide
cgccacuuuguuguuuucu

SEQ ID NO: 2298 - RNA, 19 nt, Artificial Sequence
  Description of Artificial Sequence: Synthetic oligonucleotide
ucgccacuuuguuguuuuc

SEQ ID NO: 2299 - RNA, 19 nt, Artificial Sequence
  Description of Artificial Sequence: Synthetic oligonucleotide
cucgccacuuuguuguuuu

SEQ ID NO: 2300 - RNA, 19 nt, Artificial Sequence
  Description of Artificial Sequence: Synthetic oligonucleotide
ccucgccacuuuguuguuu

SEQ ID NO: 2301 - RNA, 19 nt, Artificial Sequence
  Description of Artificial Sequence: Synthetic oligonucleotide
gccucgccacuuuguuguu

SEQ ID NO: 2302 - RNA, 19 nt, Artificial Sequence
  Description of Artificial Sequence: Synthetic oligonucleotide
ggccucgccacuuuguugu

SEQ ID NO: 2303 - RNA, 19 nt, Artificial Sequence
  Description of Artificial Sequence: Synthetic oligonucleotide
gggccucgccacuuuguug

SEQ ID NO: 2304 - RNA, 19 nt, Artificial Sequence
  Description of Artificial Sequence: Synthetic oligonucleotide
agggccucgccacuuuguu

SEQ ID NO: 2305 - RNA, 19 nt, Artificial Sequence
  Description of Artificial Sequence: Synthetic oligonucleotide
gagggccucgccacuuugu

SEQ ID NO: 2306 - RNA, 19 nt, Artificial Sequence
  Description of Artificial Sequence: Synthetic oligonucleotide
ugagggccucgccacuuug

SEQ ID NO: 2307 - RNA, 19 nt, Artificial Sequence
  Description of Artificial Sequence: Synthetic oligonucleotide
cugagggccucgccacuuu

SEQ ID NO: 2308 - RNA, 19 nt, Artificial Sequence
  Description of Artificial Sequence: Synthetic oligonucleotide
ucugagggccucgccacuu

SEQ ID NO: 2309 - RNA, 19 nt, Artificial Sequence
  Description of Artificial Sequence: Synthetic oligonucleotide
cucugagggccucgccacu

SEQ ID NO: 2310 - RNA, 19 nt, Artificial Sequence
  Description of Artificial Sequence: Synthetic oligonucleotide
acucugagggccucgccac

SEQ ID NO: 2311 - RNA, 19 nt, Artificial Sequence
  Description of Artificial Sequence: Synthetic oligonucleotide
cacucugagggccucgcca

SEQ ID NO: 2312 - RNA, 19 nt, Artificial Sequence
  Description of Artificial Sequence: Synthetic oligonucleotide
ucacucugagggccucgcc

SEQ ID NO: 2313 - RNA, 19 nt, Artificial Sequence
  Description of Artificial Sequence: Synthetic oligonucleotide
uucacucugagggccucgc

SEQ ID NO: 2314 - RNA, 19 nt, Artificial Sequence
  Description of Artificial Sequence: Synthetic oligonucleotide
uuucacucugagggccucg

SEQ ID NO: 2315 - RNA, 19 nt, Artificial Sequence
  Description of Artificial Sequence: Synthetic oligonucleotide
cuuucacucugagggccuc

SEQ ID NO: 2316 - RNA, 19 nt, Artificial Sequence
  Description of Artificial Sequence: Synthetic oligonucleotide
gcuuucacucugagggccu

SEQ ID NO: 2317 - RNA, 19 nt, Artificial Sequence
  Description of Artificial Sequence: Synthetic oligonucleotide
cgcuuucacucugagggcc

SEQ ID NO: 2318 - RNA, 19 nt, Artificial Sequence
  Description of Artificial Sequence: Synthetic oligonucleotide
acgcuuucacucugagggc

SEQ ID NO: 2319 - RNA, 19 nt, Artificial Sequence
  Description of Artificial Sequence: Synthetic oligonucleotide
uacgcuuucacucugaggg

SEQ ID NO: 2320 - RNA, 19 nt, Artificial Sequence
  Description of Artificial Sequence: Synthetic oligonucleotide
uuacgcuuucacucugagg

SEQ ID NO: 2321 - RNA, 19 nt, Artificial Sequence
  Description of Artificial Sequence: Synthetic oligonucleotide
cuuacgcuuucacucugag

SEQ ID NO: 2322 - RNA, 19 nt, Artificial Sequence
  Description of Artificial Sequence: Synthetic oligonucleotide
ccuuacgcuuucacucuga

SEQ ID NO: 2323 - RNA, 19 nt, Artificial Sequence
  Description of Artificial Sequence: Synthetic oligonucleotide
accuuacgcuuucacucug

SEQ ID NO: 2324 - RNA, 19 nt, Artificial Sequence
  Description of Artificial Sequence: Synthetic oligonucleotide
aaccuuacgcuuucacucu

SEQ ID NO: 2325 - RNA, 19 nt, Artificial Sequence
  Description of Artificial Sequence: Synthetic oligonucleotide
gaaccuuacgcuuucacuc

SEQ ID NO: 2326 - RNA, 19 nt, Artificial Sequence
  Description of Artificial Sequence: Synthetic oligonucleotide
ugaaccuuacgcuuucacu

SEQ ID NO: 2327 - RNA, 19 nt, Artificial Sequence
  Description of Artificial Sequence: Synthetic oligonucleotide
cugaaccuuacgcuuucac

SEQ ID NO: 2328 - RNA, 19 nt, Artificial Sequence
  Description of Artificial Sequence: Synthetic oligonucleotide
acugaaccuuacgcuuuca

SEQ ID NO: 2329 - RNA, 19 nt, Artificial Sequence
  Description of Artificial Sequence: Synthetic oligonucleotide
gacugaaccuuacgcuuuc

SEQ ID NO: 2330 - RNA, 19 nt, Artificial Sequence
  Description of Artificial Sequence: Synthetic oligonucleotide
ugacugaaccuuacgcuuu

SEQ ID NO: 2331 - RNA, 19 nt, Artificial Sequence
  Description of Artificial Sequence: Synthetic oligonucleotide
cugacugaaccuuacgcuu

SEQ ID NO: 2332 - RNA, 19 nt, Artificial Sequence
  Description of Artificial Sequence: Synthetic oligonucleotide
gcugacugaaccuuacgcu

SEQ ID NO: 2333 - RNA, 19 nt, Artificial Sequence
  Description of Artificial Sequence: Synthetic oligonucleotide
ggcugacugaaccuuacgc

SEQ ID NO: 2334 - RNA, 19 nt, Artificial Sequence
  Description of Artificial Sequence: Synthetic oligonucleotide
aggcugacugaaccuuacg

SEQ ID NO: 2335 - RNA, 19 nt, Artificial Sequence
  Description of Artificial Sequence: Synthetic oligonucleotide
caggcugacugaaccuuac

SEQ ID NO: 2336 - RNA, 19 nt, Artificial Sequence
  Description of Artificial Sequence: Synthetic oligonucleotide
gcaggcugacugaaccuua

SEQ ID NO: 2337 - RNA, 19 nt, Artificial Sequence
  Description of Artificial Sequence: Synthetic oligonucleotide
agcaggcugacugaaccuu

SEQ ID NO: 2338 - RNA, 19 nt, Artificial Sequence
  Description of Artificial Sequence: Synthetic oligonucleotide
cagcaggcugacugaaccu

SEQ ID NO: 2339 - RNA, 19 nt, Artificial Sequence
  Description of Artificial Sequence: Synthetic oligonucleotide
gcagcaggcugacugaacc

SEQ ID NO: 2340 - RNA, 19 nt, Artificial Sequence
  Description of Artificial Sequence: Synthetic oligonucleotide
ugcagcaggcugacugaac

SEQ ID NO: 2341 - RNA, 19 nt, Artificial Sequence
  Description of Artificial Sequence: Synthetic oligonucleotide
cugcagcaggcugacugaa

SEQ ID NO: 2342 - RNA, 19 nt, Artificial Sequence
  Description of Artificial Sequence: Synthetic oligonucleotide
gcugcagcaggcugacuga

SEQ ID NO: 2343 - RNA, 19 nt, Artificial Sequence
  Description of Artificial Sequence: Synthetic oligonucleotide
agcugcagcaggcugacug

SEQ ID NO: 2344 - RNA, 19 nt, Artificial Sequence
  Description of Artificial Sequence: Synthetic oligonucleotide
aagcugcagcaggcugacu

SEQ ID NO: 2345 - RNA, 19 nt, Artificial Sequence
  Description of Artificial Sequence: Synthetic oligonucleotide
aaagcugcagcaggcugac

SEQ ID NO: 2346 - RNA, 19 nt, Artificial Sequence
  Description of Artificial Sequence: Synthetic oligonucleotide
caaagcugcagcaggcuga

SEQ ID NO: 2347 - RNA, 19 nt, Artificial Sequence
  Description of Artificial Sequence: Synthetic oligonucleotide
gcaaagcugcagcaggcug

SEQ ID NO: 2348 - RNA, 19 nt, Artificial Sequence
  Description of Artificial Sequence: Synthetic oligonucleotide
ugcaaagcugcagcaggcu

SEQ ID NO: 2349 - RNA, 19 nt, Artificial Sequence
  Description of Artificial Sequence: Synthetic oligonucleotide
cugcaaagcugcagcaggc

SEQ ID NO: 2350 - RNA, 19 nt, Artificial Sequence
  Description of Artificial Sequence: Synthetic oligonucleotide
ucugcaaagcugcagcagg

SEQ ID NO: 2351 - RNA, 19 nt, Artificial Sequence
  Description of Artificial Sequence: Synthetic oligonucleotide
gucugcaaagcugcagcag

SEQ ID NO: 2352 - RNA, 19 nt, Artificial Sequence
  Description of Artificial Sequence: Synthetic oligonucleotide
ggucugcaaagcugcagca

SEQ ID NO: 2353 - RNA, 19 nt, Artificial Sequence
  Description of Artificial Sequence: Synthetic oligonucleotide
aggucugcaaagcugcagc

SEQ ID NO: 2354 - RNA, 19 nt, Artificial Sequence
  Description of Artificial Sequence: Synthetic oligonucleotide
gaggucugcaaagcugcag

SEQ ID NO: 2355 - RNA, 19 nt, Artificial Sequence
  Description of Artificial Sequence: Synthetic oligonucleotide
ugaggucugcaaagcugca

SEQ ID NO: 2356 - RNA, 19 nt, Artificial Sequence
  Description of Artificial Sequence: Synthetic oligonucleotide
cugaggucugcaaagcugc

SEQ ID NO: 2357 - RNA, 19 nt, Artificial Sequence
  Description of Artificial Sequence: Synthetic oligonucleotide
gcugaggucugcaaagcug

SEQ ID NO: 2358 - RNA, 19 nt, Artificial Sequence
  Description of Artificial Sequence: Synthetic oligonucleotide
agcugaggucugcaaagcu

SEQ ID NO: 2359 - RNA, 19 nt, Artificial Sequence
  Description of Artificial Sequence: Synthetic oligonucleotide
cagcugaggucugcaaagc

SEQ ID NO: 2360 - RNA, 19 nt, Artificial Sequence
  Description of Artificial Sequence: Synthetic oligonucleotide
ccagcugaggucugcaaag

SEQ ID NO: 2361 - RNA, 19 nt, Artificial Sequence
  Description of Artificial Sequence: Synthetic oligonucleotide
cccagcugaggucugcaaa

SEQ ID NO: 2362 - RNA, 19 nt, Artificial Sequence
  Description of Artificial Sequence: Synthetic oligonucleotide
gcccagcugaggucugcaa

SEQ ID NO: 2363 - RNA, 19 nt, Artificial Sequence
  Description of Artificial Sequence: Synthetic oligonucleotide
ugcccagcugaggucugca

SEQ ID NO: 2364 - RNA, 19 nt, Artificial Sequence
  Description of Artificial Sequence: Synthetic oligonucleotide
augcccagcugaggucugc

SEQ ID NO: 2365 - RNA, 19 nt, Artificial Sequence
  Description of Artificial Sequence: Synthetic oligonucleotide
gaugcccagcugaggucug

SEQ ID NO: 2366 - RNA, 19 nt, Artificial Sequence
  Description of Artificial Sequence: Synthetic oligonucleotide
agaugcccagcugaggucu

SEQ ID NO: 2367 - RNA, 19 nt, Artificial Sequence
  Description of Artificial Sequence: Synthetic oligonucleotide
gagaugcccagcugagguc

SEQ ID NO: 2368 - RNA, 19 nt, Artificial Sequence
  Description of Artificial Sequence: Synthetic oligonucleotide
ggagaugcccagcugaggu

SEQ ID NO: 2369 - RNA, 19 nt, Artificial Sequence
  Description of Artificial Sequence: Synthetic oligonucleotide
uggagaugcccagcugagg

SEQ ID NO: 2370 - RNA, 19 nt, Artificial Sequence
  Description of Artificial Sequence: Synthetic oligonucleotide
cuggagaugcccagcugag

SEQ ID NO: 2371 - RNA, 19 nt, Artificial Sequence
  Description of Artificial Sequence: Synthetic oligonucleotide
ucuggagaugcccagcuga

SEQ ID NO: 2372 - RNA, 19 nt, Artificial Sequence
  Description of Artificial Sequence: Synthetic oligonucleotide
gucuggagaugcccagcug

SEQ ID NO: 2373 - RNA, 19 nt, Artificial Sequence
  Description of Artificial Sequence: Synthetic oligonucleotide
agucuggagaugcccagcu

SEQ ID NO: 2374 - RNA, 19 nt, Artificial Sequence
  Description of Artificial Sequence: Synthetic oligonucleotide
gagucuggagaugcccagc

SEQ ID NO: 2375 - RNA, 19 nt, Artificial Sequence
  Description of Artificial Sequence: Synthetic oligonucleotide
ggagucuggagaugcccag

SEQ ID NO: 2376 - RNA, 19 nt, Artificial Sequence
  Description of Artificial Sequence: Synthetic oligonucleotide
gggagucuggagaugccca

SEQ ID NO: 2377 - RNA, 19 nt, Artificial Sequence
  Description of Artificial Sequence: Synthetic oligonucleotide
ggggagucuggagaugccc

SEQ ID NO: 2378 - RNA, 19 nt, Artificial Sequence
  Description of Artificial Sequence: Synthetic oligonucleotide
aggggagucuggagaugcc

SEQ ID NO: 2379 - RNA, 19 nt, Artificial Sequence
  Description of Artificial Sequence: Synthetic oligonucleotide
caggggagucuggagaugc

SEQ ID NO: 2380 - RNA, 19 nt, Artificial Sequence
  Description of Artificial Sequence: Synthetic oligonucleotide
ucaggggagucuggagaug

SEQ ID NO: 2381 - RNA, 19 nt, Artificial Sequence
  Description of Artificial Sequence: Synthetic oligonucleotide
uucaggggagucuggagau

SEQ ID NO: 2382 - RNA, 19 nt, Artificial Sequence
  Description of Artificial Sequence: Synthetic oligonucleotide
cuucaggggagucuggaga

SEQ ID NO: 2383 - RNA, 19 nt, Artificial Sequence
  Description of Artificial Sequence: Synthetic oligonucleotide
ccuucaggggagucuggag

SEQ ID NO: 2384 - RNA, 19 nt, Artificial Sequence
  Description of Artificial Sequence: Synthetic oligonucleotide
uccuucaggggagucugga

SEQ ID NO: 2385 - RNA, 19 nt, Artificial Sequence
  Description of Artificial Sequence: Synthetic oligonucleotide
uuccuucaggggagucugg

SEQ ID NO: 2386 - RNA, 19 nt, Artificial Sequence
  Description of Artificial Sequence: Synthetic oligonucleotide
cuuccuucaggggagucug

SEQ ID NO: 2387 - RNA, 19 nt, Artificial Sequence
  Description of Artificial Sequence: Synthetic oligonucleotide
ucuuccuucaggggagucu

SEQ ID NO: 2388 - RNA, 19 nt, Artificial Sequence
  Description of Artificial Sequence: Synthetic oligonucleotide
cucuuccuucaggggaguc

SEQ ID NO: 2389 - RNA, 19 nt, Artificial Sequence
  Description of Artificial Sequence: Synthetic oligonucleotide
gcucuuccuucaggggagu

SEQ ID NO: 2390 - RNA, 19 nt, Artificial Sequence
  Description of Artificial Sequence: Synthetic oligonucleotide
ggcucuuccuucaggggag

SEQ ID NO: 2391 - RNA, 19 nt, Artificial Sequence
  Description of Artificial Sequence: Synthetic oligonucleotide
aggcucuuccuucagggga

SEQ ID NO: 2392 - RNA, 19 nt, Artificial Sequence
  Description of Artificial Sequence: Synthetic oligonucleotide
aaggcucuuccuucagggg

SEQ ID NO: 2393 - RNA, 19 nt, Artificial Sequence
  Description of Artificial Sequence: Synthetic oligonucleotide
gaaggcucuuccuucaggg

SEQ ID NO: 2394 - RNA, 19 nt, Artificial Sequence
  Description of Artificial Sequence: Synthetic oligonucleotide
ggaaggcucuuccuucagg

SEQ ID NO: 2395 - RNA, 19 nt, Artificial Sequence
  Description of Artificial Sequence: Synthetic oligonucleotide
aggaaggcucuuccuucag

SEQ ID NO: 2396 - RNA, 19 nt, Artificial Sequence
  Description of Artificial Sequence: Synthetic oligonucleotide
gaggaaggcucuuccuuca

SEQ ID NO: 2397 - RNA, 19 nt, Artificial Sequence
  Description of Artificial Sequence: Synthetic oligonucleotide
ugaggaaggcucuuccuuc

SEQ ID NO: 2398 - RNA, 19 nt, Artificial Sequence
  Description of Artificial Sequence: Synthetic oligonucleotide
gugaggaaggcucuuccuu

SEQ ID NO: 2399 - RNA, 19 nt, Artificial Sequence
  Description of Artificial Sequence: Synthetic oligonucleotide
ggugaggaaggcucuuccu

SEQ ID NO: 2400 - RNA, 19 nt, Artificial Sequence
  Description of Artificial Sequence: Synthetic oligonucleotide
gggugaggaaggcucuucc

SEQ ID NO: 2401 - RNA, 19 nt, Artificial Sequence
  Description of Artificial Sequence: Synthetic oligonucleotide
ugggugaggaaggcucuuc

SEQ ID NO: 2402 - RNA, 19 nt, Artificial Sequence
  Description of Artificial Sequence: Synthetic oligonucleotide
uugggugaggaaggcucuu

SEQ ID NO: 2403 - RNA, 19 nt, Artificial Sequence
  Description of Artificial Sequence: Synthetic oligonucleotide
uuugggugaggaaggcucu

SEQ ID NO: 2404 - RNA, 19 nt, Artificial Sequence
  Description of Artificial Sequence: Synthetic oligonucleotide
guuugggugaggaaggcuc

SEQ ID NO: 2405 - RNA, 19 nt, Artificial Sequence
  Description of Artificial Sequence: Synthetic oligonucleotide
gguuugggugaggaaggcu

SEQ ID NO: 2406 - RNA, 19 nt, Artificial Sequence
  Description of Artificial Sequence: Synthetic oligonucleotide
ggguuugggugaggaaggc

SEQ ID NO: 2407 - RNA, 19 nt, Artificial Sequence
  Description of Artificial Sequence: Synthetic oligonucleotide
uggguuugggugaggaagg

SEQ ID NO: 2408 - RNA, 19 nt, Artificial Sequence
  Description of Artificial Sequence: Synthetic oligonucleotide
guggguuugggugaggaag

SEQ ID NO: 2409 - RNA, 19 nt, Artificial Sequence
  Description of Artificial Sequence: Synthetic oligonucleotide
uguggguuugggugaggaa

SEQ ID NO: 2410 - RNA, 19 nt, Artificial Sequence
  Description of Artificial Sequence: Synthetic oligonucleotide
uuguggguuugggugagga

SEQ ID NO: 2411 - RNA, 19 nt, Artificial Sequence
  Description of Artificial Sequence: Synthetic oligonucleotide
uuuguggguuugggugagg

SEQ ID NO: 2412 - RNA, 19 nt, Artificial Sequence
  Description of Artificial Sequence: Synthetic oligonucleotide
uuuuguggguuugggugag

SEQ ID NO: 2413 - RNA, 19 nt, Artificial Sequence
  Description of Artificial Sequence: Synthetic oligonucleotide
cuuuuguggguuuggguga

SEQ ID NO: 2414 - RNA, 19 nt, Artificial Sequence
  Description of Artificial Sequence: Synthetic oligonucleotide
ucuuuuguggguuugggug

SEQ ID NO: 2415 - RNA, 19 nt, Artificial Sequence
  Description of Artificial Sequence: Synthetic oligonucleotide
aucuuuuguggguuugggu

SEQ ID NO: 2416 - RNA, 19 nt, Artificial Sequence
  Description of Artificial Sequence: Synthetic oligonucleotide
caucuuuuguggguuuggg

SEQ ID NO: 2417 - RNA, 19 nt, Artificial Sequence
  Description of Artificial Sequence: Synthetic oligonucleotide
gcaucuuuuguggguuugg

SEQ ID NO: 2418 - RNA, 19 nt, Artificial Sequence
  Description of Artificial Sequence: Synthetic oligonucleotide
agcaucuuuuguggguuug

SEQ ID NO: 2419 - RNA, 19 nt, Artificial Sequence
  Description of Artificial Sequence: Synthetic oligonucleotide
cagcaucuuuuguggguuu

SEQ ID NO: 2420 - RNA, 19 nt, Artificial Sequence
  Description of Artificial Sequence: Synthetic oligonucleotide
ucagcaucuuuuguggguu

SEQ ID NO: 2421 - RNA, 19 nt, Artificial Sequence
  Description of Artificial Sequence: Synthetic oligonucleotide
uucagcaucuuuugugggu

SEQ ID NO: 2422 - RNA, 19 nt, Artificial Sequence
  Description of Artificial Sequence: Synthetic oligonucleotide
uuucagcaucuuuuguggg

SEQ ID NO: 2423 - RNA, 19 nt, Artificial Sequence
  Description of Artificial Sequence: Synthetic oligonucleotide
uuuucagcaucuuuugugg

SEQ ID NO: 2424 - RNA, 19 nt, Artificial Sequence
  Description of Artificial Sequence: Synthetic oligonucleotide
uuuuucagcaucuuuugug

SEQ ID NO: 2425 - RNA, 19 nt, Artificial Sequence
  Description of Artificial Sequence: Synthetic oligonucleotide
cuuuuucagcaucuuuugu

SEQ ID NO: 2426 - RNA, 19 nt, Artificial Sequence
  Description of Artificial Sequence: Synthetic oligonucleotide
gcuuuuucagcaucuuuug

SEQ ID NO: 2427 - RNA, 19 nt, Artificial Sequence
  Description of Artificial Sequence: Synthetic oligonucleotide
ggcuuuuucagcaucuuuu

SEQ ID NO: 2428 - RNA, 19 nt, Artificial Sequence
  Description of Artificial Sequence: Synthetic oligonucleotide
aggcuuuuucagcaucuuu

SEQ ID NO: 2429 - RNA, 19 nt, Artificial Sequence
  Description of Artificial Sequence: Synthetic oligonucleotide
gaggcuuuuucagcaucuu

SEQ ID NO: 2430 - RNA, 19 nt, Artificial Sequence
  Description of Artificial Sequence: Synthetic oligonucleotide
agaggcuuuuucagcaucu

SEQ ID NO: 2431 - RNA, 19 nt, Artificial Sequence
  Description of Artificial Sequence: Synthetic oligonucleotide
gagaggcuuuuucagcauc

SEQ ID NO: 2432 - RNA, 19 nt, Artificial Sequence
  Description of Artificial Sequence: Synthetic oligonucleotide
agagaggcuuuuucagcau

SEQ ID NO: 2433 - RNA, 19 nt, Artificial Sequence
  Description of Artificial Sequence: Synthetic oligonucleotide
gagagaggcuuuuucagca

SEQ ID NO: 2434 - RNA, 19 nt, Artificial Sequence
  Description of Artificial Sequence: Synthetic oligonucleotide
ugagagaggcuuuuucagc

SEQ ID NO: 2435 - RNA, 19 nt, Artificial Sequence
  Description of Artificial Sequence: Synthetic oligonucleotide
cugagagaggcuuuuucag

SEQ ID NO: 2436 - RNA, 19 nt, Artificial Sequence
  Description of Artificial Sequence: Synthetic oligonucleotide
gcugagagaggcuuuuuca

SEQ ID NO: 2437 - RNA, 19 nt, Artificial Sequence
  Description of Artificial Sequence: Synthetic oligonucleotide
agcugagagaggcuuuuuc

SEQ ID NO: 2438 - RNA, 19 nt, Artificial Sequence
  Description of Artificial Sequence: Synthetic oligonucleotide
cagcugagagaggcuuuuu

SEQ ID NO: 2439 - RNA, 19 nt, Artificial Sequence
  Description of Artificial Sequence: Synthetic oligonucleotide
acagcugagagaggcuuuu

SEQ ID NO: 2440 - RNA, 19 nt, Artificial Sequence
  Description of Artificial Sequence: Synthetic oligonucleotide
cacagcugagagaggcuuu

SEQ ID NO: 2441 - RNA, 19 nt, Artificial Sequence
  Description of Artificial Sequence: Synthetic oligonucleotide
ucacagcugagagaggcuu

SEQ ID NO: 2442 - RNA, 19 nt, Artificial Sequence
  Description of Artificial Sequence: Synthetic oligonucleotide
gucacagcugagagaggcu

SEQ ID NO: 2443 - RNA, 19 nt, Artificial Sequence
  Description of Artificial Sequence: Synthetic oligonucleotide
ggucacagcugagagaggc

SEQ ID NO: 2444 - RNA, 19 nt, Artificial Sequence
  Description of Artificial Sequence: Synthetic oligonucleotide
aggucacagcugagagagg

SEQ ID NO: 2445 - RNA, 19 nt, Artificial Sequence
  Description of Artificial Sequence: Synthetic oligonucleotide
caggucacagcugagagag

SEQ ID NO: 2446 - RNA, 19 nt, Artificial Sequence
  Description of Artificial Sequence: Synthetic oligonucleotide
ccaggucacagcugagaga

SEQ ID NO: 2447 - RNA, 19 nt, Artificial Sequence
  Description of Artificial Sequence: Synthetic oligonucleotide
gccaggucacagcugagag

SEQ ID NO: 2448 - RNA, 19 nt, Artificial Sequence
  Description of Artificial Sequence: Synthetic oligonucleotide
agccaggucacagcugaga

SEQ ID NO: 2449 - RNA, 19 nt, Artificial Sequence
  Description of Artificial Sequence: Synthetic oligonucleotide
gagccaggucacagcugag

SEQ ID NO: 2450 - RNA, 19 nt, Artificial Sequence
  Description of Artificial Sequence: Synthetic oligonucleotide
agagccaggucacagcuga

SEQ ID NO: 2451 - RNA, 19 nt, Artificial Sequence
  Description of Artificial Sequence: Synthetic oligonucleotide
cagagccaggucacagcug

SEQ ID NO: 2452 - RNA, 19 nt, Artificial Sequence
  Description of Artificial Sequence: Synthetic oligonucleotide
gcagagccaggucacagcu

SEQ ID NO: 2453 - RNA, 19 nt, Artificial Sequence
  Description of Artificial Sequence: Synthetic oligonucleotide
ugcagagccaggucacagc

SEQ ID NO: 2454 - RNA, 19 nt, Artificial Sequence
  Description of Artificial Sequence: Synthetic oligonucleotide
augcagagccaggucacag

SEQ ID NO: 2455 - RNA, 19 nt, Artificial Sequence
  Description of Artificial Sequence: Synthetic oligonucleotide
aaugcagagccaggucaca

SEQ ID NO: 2456 - RNA, 19 nt, Artificial Sequence
  Description of Artificial Sequence: Synthetic oligonucleotide
aaaugcagagccaggucac

SEQ ID NO: 2457 - RNA, 19 nt, Artificial Sequence
  Description of Artificial Sequence: Synthetic oligonucleotide
aaaaugcagagccagguca

SEQ ID NO: 2458 - RNA, 19 nt, Artificial Sequence
  Description of Artificial Sequence: Synthetic oligonucleotide
gaaaaugcagagccagguc

SEQ ID NO: 2459 - RNA, 19 nt, Artificial Sequence
  Description of Artificial Sequence: Synthetic oligonucleotide
ugaaaaugcagagccaggu

SEQ ID NO: 2460 - RNA, 19 nt, Artificial Sequence
  Description of Artificial Sequence: Synthetic oligonucleotide
augaaaaugcagagccagg

SEQ ID NO: 2461 - RNA, 19 nt, Artificial Sequence
  Description of Artificial Sequence: Synthetic oligonucleotide
gaugaaaaugcagagccag

SEQ ID NO: 2462 - RNA, 19 nt, Artificial Sequence
  Description of Artificial Sequence: Synthetic oligonucleotide
cgaugaaaaugcagagcca

SEQ ID NO: 2463 - RNA, 19 nt, Artificial Sequence
  Description of Artificial Sequence: Synthetic oligonucleotide
acgaugaaaaugcagagcc

SEQ ID NO: 2464 - RNA, 19 nt, Artificial Sequence
  Description of Artificial Sequence: Synthetic oligonucleotide
cacgaugaaaaugcagagc

SEQ ID NO: 2465 - RNA, 19 nt, Artificial Sequence
  Description of Artificial Sequence: Synthetic oligonucleotide
ccacgaugaaaaugcagag

SEQ ID NO: 2466 - RNA, 19 nt, Artificial Sequence
  Description of Artificial Sequence: Synthetic oligonucleotide
gccacgaugaaaaugcaga

SEQ ID NO: 2467 - RNA, 19 nt, Artificial Sequence
  Description of Artificial Sequence: Synthetic oligonucleotide
ggccacgaugaaaaugcag

SEQ ID NO: 2468 - RNA, 19 nt, Artificial Sequence
  Description of Artificial Sequence: Synthetic oligonucleotide
aggccacgaugaaaaugca

SEQ ID NO: 2469 - RNA, 19 nt, Artificial Sequence
  Description of Artificial Sequence: Synthetic oligonucleotide
aaggccacgaugaaaaugc

SEQ ID NO: 2470 - RNA, 19 nt, Artificial Sequence
  Description of Artificial Sequence: Synthetic oligonucleotide
aaaggccacgaugaaaaug

SEQ ID NO: 2471 - RNA, 19 nt, Artificial Sequence
  Description of Artificial Sequence: Synthetic oligonucleotide
caaaggccacgaugaaaau

SEQ ID NO: 2472 - RNA, 19 nt, Artificial Sequence
  Description of Artificial Sequence: Synthetic oligonucleotide
acaaaggccacgaugaaaa

SEQ ID NO: 2473 - RNA, 19 nt, Artificial Sequence
  Description of Artificial Sequence: Synthetic oligonucleotide
gacaaaggccacgaugaaa

SEQ ID NO: 2474 - RNA, 19 nt, Artificial Sequence
  Description of Artificial Sequence: Synthetic oligonucleotide
ugacaaaggccacgaugaa

SEQ ID NO: 2475 - RNA, 19 nt, Artificial Sequence
  Description of Artificial Sequence: Synthetic oligonucleotide
cugacaaaggccacgauga

SEQ ID NO: 2476 - RNA, 19 nt, Artificial Sequence
  Description of Artificial Sequence: Synthetic oligonucleotide
gcugacaaaggccacgaug

SEQ ID NO: 2477 - RNA, 19 nt, Artificial Sequence
  Description of Artificial Sequence: Synthetic oligonucleotide
ggcugacaaaggccacgau

SEQ ID NO: 2478 - RNA, 19 nt, Artificial Sequence
  Description of Artificial Sequence: Synthetic oligonucleotide
uggcugacaaaggccacga

SEQ ID NO: 2479 - RNA, 19 nt, Artificial Sequence
  Description of Artificial Sequence: Synthetic oligonucleotide
guggcugacaaaggccacg

SEQ ID NO: 2480 - RNA, 19 nt, Artificial Sequence
  Description of Artificial Sequence: Synthetic oligonucleotide
gguggcugacaaaggccac

SEQ ID NO: 2481 - RNA, 19 nt, Artificial Sequence
  Description of Artificial Sequence: Synthetic oligonucleotide
ggguggcugacaaaggcca

SEQ ID NO: 2482 - RNA, 19 nt, Artificial Sequence
  Description of Artificial Sequence: Synthetic oligonucleotide
uggguggcugacaaaggcc

SEQ ID NO: 2483 - RNA, 19 nt, Artificial Sequence
  Description of Artificial Sequence: Synthetic oligonucleotide
cuggguggcugacaaaggc

SEQ ID NO: 2484 - RNA, 19 nt, Artificial Sequence
  Description of Artificial Sequence: Synthetic oligonucleotide
gcuggguggcugacaaagg

SEQ ID NO: 2485 - RNA, 19 nt, Artificial Sequence
  Description of Artificial Sequence: Synthetic oligonucleotide
cgcuggguggcugacaaag

SEQ ID NO: 2486 - RNA, 19 nt, Artificial Sequence
  Description of Artificial Sequence: Synthetic oligonucleotide
acgcuggguggcugacaaa

SEQ ID NO: 2487 - RNA, 19 nt, Artificial Sequence
  Description of Artificial Sequence: Synthetic oligonucleotide
cacgcuggguggcugacaa

SEQ ID NO: 2488 - RNA, 19 nt, Artificial Sequence
  Description of Artificial Sequence: Synthetic oligonucleotide
ccacgcuggguggcugaca

SEQ ID NO: 2489 - RNA, 19 nt, Artificial Sequence
  Description of Artificial Sequence: Synthetic oligonucleotide
gccacgcuggguggcugac

SEQ ID NO: 2490 - RNA, 19 nt, Artificial Sequence
  Description of Artificial Sequence: Synthetic oligonucleotide
agccacgcuggguggcuga

SEQ ID NO: 2491 - RNA, 19 nt, Artificial Sequence
  Description of Artificial Sequence: Synthetic oligonucleotide
cagccacgcuggguggcug

SEQ ID NO: 2492 - RNA, 19 nt, Artificial Sequence
  Description of Artificial Sequence: Synthetic oligonucleotide
gcagccacgcuggguggcu

SEQ ID NO: 2493 - RNA, 19 nt, Artificial Sequence
  Description of Artificial Sequence: Synthetic oligonucleotide
ugcagccacgcuggguggc

SEQ ID NO: 2494 - RNA, 19 nt, Artificial Sequence
  Description of Artificial Sequence: Synthetic oligonucleotide
cugcagccacgcugggugg

SEQ ID NO: 2495 - RNA, 19 nt, Artificial Sequence
  Description of Artificial Sequence: Synthetic oligonucleotide
ucugcagccacgcugggug

SEQ ID NO: 2496 - RNA, 19 nt, Artificial Sequence
  Description of Artificial Sequence: Synthetic oligonucleotide
uucugcagccacgcugggu

SEQ ID NO: 2497 - RNA, 19 nt, Artificial Sequence
  Description of Artificial Sequence: Synthetic oligonucleotide
cuucugcagccacgcuggg

SEQ ID NO: 2498 - RNA, 19 nt, Artificial Sequence
  Description of Artificial Sequence: Synthetic oligonucleotide
gcuucugcagccacgcugg

SEQ ID NO: 2499 - RNA, 19 nt, Artificial Sequence
  Description of Artificial Sequence: Synthetic oligonucleotide
agcuucugcagccacgcug

SEQ ID NO: 2500 - RNA, 19 nt, Artificial Sequence
  Description of Artificial Sequence: Synthetic oligonucleotide
gagcuucugcagccacgcu

SEQ ID NO: 2501 - RNA, 19 nt, Artificial Sequence
  Description of Artificial Sequence: Synthetic oligonucleotide
agagcuucugcagccacgc

SEQ ID NO: 2502 - RNA, 19 nt, Artificial Sequence
  Description of Artificial Sequence: Synthetic oligonucleotide
gagagcuucugcagccacg

SEQ ID NO: 2503 - RNA, 19 nt, Artificial Sequence
  Description of Artificial Sequence: Synthetic oligonucleotide
agagagcuucugcagccac

SEQ ID NO: 2504 - RNA, 19 nt, Artificial Sequence
  Description of Artificial Sequence: Synthetic oligonucleotide
uagagagcuucugcagcca

SEQ ID NO: 2505 - RNA, 19 nt, Artificial Sequence
  Description of Artificial Sequence: Synthetic oligonucleotide
uuagagagcuucugcagcc

SEQ ID NO: 2506 - RNA, 19 nt, Artificial Sequence
  Description of Artificial Sequence: Synthetic oligonucleotide
cuuagagagcuucugcagc

SEQ ID NO: 2507 - RNA, 19 nt, Artificial Sequence
  Description of Artificial Sequence: Synthetic oligonucleotide
gcuuagagagcuucugcag

SEQ ID NO: 2508 - RNA, 19 nt, Artificial Sequence
  Description of Artificial Sequence: Synthetic oligonucleotide
ugcuuagagagcuucugca

SEQ ID NO: 2509 - RNA, 19 nt, Artificial Sequence
  Description of Artificial Sequence: Synthetic oligonucleotide
gugcuuagagagcuucugc

SEQ ID NO: 2510 - RNA, 19 nt, Artificial Sequence
  Description of Artificial Sequence: Synthetic oligonucleotide
ugugcuuagagagcuucug

SEQ ID NO: 2511 - RNA, 19 nt, Artificial Sequence
  Description of Artificial Sequence: Synthetic oligonucleotide
uugugcuuagagagcuucu

SEQ ID NO: 2512 - RNA, 19 nt, Artificial Sequence
  Description of Artificial Sequence: Synthetic oligonucleotide
cuugugcuuagagagcuuc

SEQ ID NO: 2513 - RNA, 19 nt, Artificial Sequence
  Description of Artificial Sequence: Synthetic oligonucleotide
ucuugugcuuagagagcuu

SEQ ID NO: 2514 - RNA, 19 nt, Artificial Sequence
  Description of Artificial Sequence: Synthetic oligonucleotide
gucuugugcuuagagagcu

SEQ ID NO: 2515 - RNA, 19 nt, Artificial Sequence
  Description of Artificial Sequence: Synthetic oligonucleotide
ugucuugugcuuagagagc

SEQ ID NO: 2516 - RNA, 19 nt, Artificial Sequence
  Description of Artificial Sequence: Synthetic oligonucleotide
gugucuugugcuuagagag

SEQ ID NO: 2517 - RNA, 19 nt, Artificial Sequence
  Description of Artificial Sequence: Synthetic oligonucleotide
ggugucuugugcuuagaga

SEQ ID NO: 2518 - RNA, 19 nt, Artificial Sequence
  Description of Artificial Sequence: Synthetic oligonucleotide
uggugucuugugcuuagag

SEQ ID NO: 2519 - RNA, 19 nt, Artificial Sequence
  Description of Artificial Sequence: Synthetic oligonucleotide
cuggugucuugugcuuaga

SEQ ID NO: 2520 - RNA, 19 nt, Artificial Sequence
  Description of Artificial Sequence: Synthetic oligonucleotide
gcuggugucuugugcuuag

SEQ ID NO: 2521 - RNA, 19 nt, Artificial Sequence
  Description of Artificial Sequence: Synthetic oligonucleotide
ugcuggugucuugugcuua

SEQ ID NO: 2522 - RNA, 19 nt, Artificial Sequence
  Description of Artificial Sequence: Synthetic oligonucleotide
gugcuggugucuugugcuu

SEQ ID NO: 2523 - RNA, 19 nt, Artificial Sequence
  Description of Artificial Sequence: Synthetic oligonucleotide
ugugcuggugucuugugcu

SEQ ID NO: 2524 - RNA, 19 nt, Artificial Sequence
  Description of Artificial Sequence: Synthetic oligonucleotide
cugugcuggugucuugugc

SEQ ID NO: 2525 - RNA, 19 nt, Artificial Sequence
  Description of Artificial Sequence: Synthetic oligonucleotide
gcugugcuggugucuugug

SEQ ID NO: 2526 - RNA, 19 nt, Artificial Sequence
  Description of Artificial Sequence: Synthetic oligonucleotide
ggcugugcuggugucuugu

SEQ ID NO: 2527 - RNA, 19 nt, Artificial Sequence
  Description of Artificial Sequence: Synthetic oligonucleotide
uggcugugcuggugucuug

SEQ ID NO: 2528 - RNA, 19 nt, Artificial Sequence
  Description of Artificial Sequence: Synthetic oligonucleotide
guggcugugcuggugucuu

SEQ ID NO: 2529 - RNA, 19 nt, Artificial Sequence
  Description of Artificial Sequence: Synthetic oligonucleotide
uguggcugugcuggugucu

SEQ ID NO: 2530 - RNA, 19 nt, Artificial Sequence
  Description of Artificial Sequence: Synthetic oligonucleotide
cuguggcugugcugguguc

SEQ ID NO: 2531 - RNA, 19 nt, Artificial Sequence
  Description of Artificial Sequence: Synthetic oligonucleotide
gcuguggcugugcuggugu

SEQ ID NO: 2532 - RNA, 19 nt, Artificial Sequence
  Description of Artificial Sequence: Synthetic oligonucleotide
agcuguggcugugcuggug

SEQ ID NO: 2533 - RNA, 19 nt, Artificial Sequence
  Description of Artificial Sequence: Synthetic oligonucleotide
gagcuguggcugugcuggu

SEQ ID NO: 2534 - RNA, 19 nt, Artificial Sequence
  Description of Artificial Sequence: Synthetic oligonucleotide
ugagcuguggcugugcugg

SEQ ID NO: 2535 - RNA, 19 nt, Artificial Sequence
  Description of Artificial Sequence: Synthetic oligonucleotide
uugagcuguggcugugcug

SEQ ID NO: 2536 - RNA, 19 nt, Artificial Sequence
  Description of Artificial Sequence: Synthetic oligonucleotide
uuugagcuguggcugugcu

SEQ ID NO: 2537 - RNA, 19 nt, Artificial Sequence
  Description of Artificial Sequence: Synthetic oligonucleotide
cuuugagcuguggcugugc

SEQ ID NO: 2538 - RNA, 19 nt, Artificial Sequence
  Description of Artificial Sequence: Synthetic oligonucleotide
gcuuugagcuguggcugug

SEQ ID NO: 2539 - RNA, 19 nt, Artificial Sequence
  Description of Artificial Sequence: Synthetic oligonucleotide
cgcuuugagcuguggcugu

SEQ ID NO: 2540 - RNA, 19 nt, Artificial Sequence
  Description of Artificial Sequence: Synthetic oligonucleotide
ccgcuuugagcuguggcug

SEQ ID NO: 2541 - RNA, 19 nt, Artificial Sequence
  Description of Artificial Sequence: Synthetic oligonucleotide
gccgcuuugagcuguggcu

SEQ ID NO: 2542 - RNA, 19 nt, Artificial Sequence
  Description of Artificial Sequence: Synthetic oligonucleotide
ggccgcuuugagcuguggc

SEQ ID NO: 2543 - RNA, 19 nt, Artificial Sequence
  Description of Artificial Sequence: Synthetic oligonucleotide
uggccgcuuugagcugugg

SEQ ID NO: 2544 - RNA, 19 nt, Artificial Sequence
  Description of Artificial Sequence: Synthetic oligonucleotide
uuggccgcuuugagcugug

SEQ ID NO: 2545 - RNA, 19 nt, Artificial Sequence
  Description of Artificial Sequence: Synthetic oligonucleotide
guuggccgcuuugagcugu

SEQ ID NO: 2546 - RNA, 19 nt, Artificial Sequence
  Description of Artificial Sequence: Synthetic oligonucleotide
aguuggccgcuuugagcug

SEQ ID NO: 2547 - RNA, 19 nt, Artificial Sequence
  Description of Artificial Sequence: Synthetic oligonucleotide
caguuggccgcuuugagcu

SEQ ID NO: 2548 - RNA, 19 nt, Artificial Sequence
  Description of Artificial Sequence: Synthetic oligonucleotide
gcaguuggccgcuuugagc

SEQ ID NO: 2549 - RNA, 19 nt, Artificial Sequence
  Description of Artificial Sequence: Synthetic oligonucleotide
agcaguuggccgcuuugag

SEQ ID NO: 2550 - RNA, 19 nt, Artificial Sequence
  Description of Artificial Sequence: Synthetic oligonucleotide
cagcaguuggccgcuuuga

SEQ ID NO: 2551 - RNA, 19 nt, Artificial Sequence
  Description of Artificial Sequence: Synthetic oligonucleotide
acagcaguuggccgcuuug

SEQ ID NO: 2552 - RNA, 19 nt, Artificial Sequence
  Description of Artificial Sequence: Synthetic oligonucleotide
cacagcaguuggccgcuuu

SEQ ID NO: 2553 - RNA, 19 nt, Artificial Sequence
  Description of Artificial Sequence: Synthetic oligonucleotide
ucacagcaguuggccgcuu

SEQ ID NO: 2554 - RNA, 19 nt, Artificial Sequence
  Description of Artificial Sequence: Synthetic oligonucleotide
cucacagcaguuggccgcu

SEQ ID NO: 2555 - RNA, 19 nt, Artificial Sequence
  Description of Artificial Sequence: Synthetic oligonucleotide
ccucacagcaguuggccgc

SEQ ID NO: 2556 - RNA, 19 nt, Artificial Sequence
  Description of Artificial Sequence: Synthetic oligonucleotide
uccucacagcaguuggccg

SEQ ID NO: 2557 - RNA, 19 nt, Artificial Sequence
  Description of Artificial Sequence: Synthetic oligonucleotide
cuccucacagcaguuggcc

SEQ ID NO: 2558 - RNA, 19 nt, Artificial Sequence
  Description of Artificial Sequence: Synthetic oligonucleotide
ccuccucacagcaguuggc

SEQ ID NO: 2559 - RNA, 19 nt, Artificial Sequence
  Description of Artificial Sequence: Synthetic oligonucleotide
accuccucacagcaguugg

SEQ ID NO: 2560 - RNA, 19 nt, Artificial Sequence
  Description of Artificial Sequence: Synthetic oligonucleotide
caccuccucacagcaguug

SEQ ID NO: 2561 - RNA, 19 nt, Artificial Sequence
  Description of Artificial Sequence: Synthetic oligonucleotide
ucaccuccucacagcaguu

SEQ ID NO: 2562 - RNA, 19 nt, Artificial Sequence
  Description of Artificial Sequence: Synthetic oligonucleotide
uucaccuccucacagcagu

SEQ ID NO: 2563 - RNA, 19 nt, Artificial Sequence
  Description of Artificial Sequence: Synthetic oligonucleotide
cuucaccuccucacagcag

SEQ ID NO: 2564 - RNA, 19 nt, Artificial Sequence
  Description of Artificial Sequence: Synthetic oligonucleotide
ccuucaccuccucacagca

SEQ ID NO: 2565 - RNA, 19 nt, Artificial Sequence
  Description of Artificial Sequence: Synthetic oligonucleotide
uccuucaccuccucacagc

SEQ ID NO: 2566 - RNA, 19 nt, Artificial Sequence
  Description of Artificial Sequence: Synthetic oligonucleotide
cuccuucaccuccucacag

SEQ ID NO: 2567 - RNA, 19 nt, Artificial Sequence
  Description of Artificial Sequence: Synthetic oligonucleotide
gcuccuucaccuccucaca

SEQ ID NO: 2568 - RNA, 19 nt, Artificial Sequence
  Description of Artificial Sequence: Synthetic oligonucleotide
agcuccuucaccuccucac

SEQ ID NO: 2569 - RNA, 19 nt, Artificial Sequence
  Description of Artificial Sequence: Synthetic oligonucleotide
gagcuccuucaccuccuca

SEQ ID NO: 2570 - RNA, 19 nt, Artificial Sequence
  Description of Artificial Sequence: Synthetic oligonucleotide
ugagcuccuucaccuccuc

SEQ ID NO: 2571 - RNA, 19 nt, Artificial Sequence
  Description of Artificial Sequence: Synthetic oligonucleotide
uugagcuccuucaccuccu

SEQ ID NO: 2572 - RNA, 19 nt, Artificial Sequence
  Description of Artificial Sequence: Synthetic oligonucleotide
cuugagcuccuucaccucc

SEQ ID NO: 2573 - RNA, 19 nt, Artificial Sequence
  Description of Artificial Sequence: Synthetic oligonucleotide
ccuugagcuccuucaccuc

SEQ ID NO: 2574 - RNA, 19 nt, Artificial Sequence
  Description of Artificial Sequence: Synthetic oligonucleotide
gccuugagcuccuucaccu

SEQ ID NO: 2575 - RNA, 19 nt, Artificial Sequence
  Description of Artificial Sequence: Synthetic oligonucleotide
ggccuugagcuccuucacc

SEQ ID NO: 2576 - RNA, 19 nt, Artificial Sequence
  Description of Artificial Sequence: Synthetic oligonucleotide
gggccuugagcuccuucac

SEQ ID NO: 2577 - RNA, 19 nt, Artificial Sequence
  Description of Artificial Sequence: Synthetic oligonucleotide
ugggccuugagcuccuuca

SEQ ID NO: 2578 - RNA, 19 nt, Artificial Sequence
  Description of Artificial Sequence: Synthetic oligonucleotide
uugggccuugagcuccuuc

SEQ ID NO: 2579 - RNA, 19 nt, Artificial Sequence
  Description of Artificial Sequence: Synthetic oligonucleotide
cuugggccuugagcuccuu

SEQ ID NO: 2580 - RNA, 19 nt, Artificial Sequence
  Description of Artificial Sequence: Synthetic oligonucleotide
acuugggccuugagcuccu

SEQ ID NO: 2581 - RNA, 19 nt, Artificial Sequence
  Description of Artificial Sequence: Synthetic oligonucleotide
aacuugggccuugagcucc

SEQ ID NO: 2582 - RNA, 19 nt, Artificial Sequence
  Description of Artificial Sequence: Synthetic oligonucleotide
caacuugggccuugagcuc

SEQ ID NO: 2583 - RNA, 19 nt, Artificial Sequence
  Description of Artificial Sequence: Synthetic oligonucleotide
gcaacuugggccuugagcu

SEQ ID NO: 2584 - RNA, 19 nt, Artificial Sequence
  Description of Artificial Sequence: Synthetic oligonucleotide
ggcaacuugggccuugagc

SEQ ID NO: 2585 - RNA, 19 nt, Artificial Sequence
  Description of Artificial Sequence: Synthetic oligonucleotide
uggcaacuugggccuugag

SEQ ID NO: 2586 - RNA, 19 nt, Artificial Sequence
  Description of Artificial Sequence: Synthetic oligonucleotide
uuggcaacuugggccuuga

SEQ ID NO: 2587 - RNA, 19 nt, Artificial Sequence
  Description of Artificial Sequence: Synthetic oligonucleotide
guuggcaacuugggccuug

SEQ ID NO: 2588 - RNA, 19 nt, Artificial Sequence
  Description of Artificial Sequence: Synthetic oligonucleotide
gguuggcaacuugggccuu

SEQ ID NO: 2589 - RNA, 19 nt, Artificial Sequence
  Description of Artificial Sequence: Synthetic oligonucleotide
agguuggcaacuugggccu

SEQ ID NO: 2590 - RNA, 19 nt, Artificial Sequence
  Description of Artificial Sequence: Synthetic oligonucleotide
aagguuggcaacuugggcc

SEQ ID NO: 2591 - RNA, 19 nt, Artificial Sequence
  Description of Artificial Sequence: Synthetic oligonucleotide
uaagguuggcaacuugggc

SEQ ID NO: 2592 - RNA, 19 nt, Artificial Sequence
  Description of Artificial Sequence: Synthetic oligonucleotide
cuaagguuggcaacuuggg

SEQ ID NO: 2593 - RNA, 19 nt, Artificial Sequence
  Description of Artificial Sequence: Synthetic oligonucleotide
gcuaagguuggcaacuugg

SEQ ID NO: 2594 - RNA, 19 nt, Artificial Sequence
  Description of Artificial Sequence: Synthetic oligonucleotide
ugcuaagguuggcaacuug

SEQ ID NO: 2595 - RNA, 19 nt, Artificial Sequence
  Description of Artificial Sequence: Synthetic oligonucleotide
cugcuaagguuggcaacuu

SEQ ID NO: 2596 - RNA, 19 nt, Artificial Sequence
  Description of Artificial Sequence: Synthetic oligonucleotide
gcugcuaagguuggcaacu

SEQ ID NO: 2597 - RNA, 19 nt, Artificial Sequence
  Description of Artificial Sequence: Synthetic oligonucleotide
ggcugcuaagguuggcaac

SEQ ID NO: 2598 - RNA, 19 nt, Artificial Sequence
  Description of Artificial Sequence: Synthetic oligonucleotide
aggcugcuaagguuggcaa

SEQ ID NO: 2599 - RNA, 19 nt, Artificial Sequence
  Description of Artificial Sequence: Synthetic oligonucleotide
caggcugcuaagguuggca

SEQ ID NO: 2600 - RNA, 19 nt, Artificial Sequence
  Description of Artificial Sequence: Synthetic oligonucleotide
gcaggcugcuaagguuggc

SEQ ID NO: 2601 - RNA, 19 nt, Artificial Sequence
  Description of Artificial Sequence: Synthetic oligonucleotide
agcaggcugcuaagguugg

SEQ ID NO: 2602 - RNA, 19 nt, Artificial Sequence
  Description of Artificial Sequence: Synthetic oligonucleotide
cagcaggcugcuaagguug

SEQ ID NO: 2603 - RNA, 19 nt, Artificial Sequence
  Description of Artificial Sequence: Synthetic oligonucleotide
ucagcaggcugcuaagguu

SEQ ID NO: 2604 - RNA, 19 nt, Artificial Sequence
  Description of Artificial Sequence: Synthetic oligonucleotide
cucagcaggcugcuaaggu

SEQ ID NO: 2605 - RNA, 19 nt, Artificial Sequence
  Description of Artificial Sequence: Synthetic oligonucleotide
acucagcaggcugcuaagg

SEQ ID NO: 2606 - RNA, 19 nt, Artificial Sequence
  Description of Artificial Sequence: Synthetic oligonucleotide
cacucagcaggcugcuaag

SEQ ID NO: 2607 - RNA, 19 nt, Artificial Sequence
  Description of Artificial Sequence: Synthetic oligonucleotide
ucacucagcaggcugcuaa

SEQ ID NO: 2608 - RNA, 19 nt, Artificial Sequence
  Description of Artificial Sequence: Synthetic oligonucleotide
uucacucagcaggcugcua

SEQ ID NO: 2609 - RNA, 19 nt, Artificial Sequence
  Description of Artificial Sequence: Synthetic oligonucleotide
guucacucagcaggcugcu

SEQ ID NO: 2610 - RNA, 19 nt, Artificial Sequence
  Description of Artificial Sequence: Synthetic oligonucleotide
aguucacucagcaggcugc

SEQ ID NO: 2611 - RNA, 19 nt, Artificial Sequence
  Description of Artificial Sequence: Synthetic oligonucleotide
caguucacucagcaggcug

SEQ ID NO: 2612 - RNA, 19 nt, Artificial Sequence
  Description of Artificial Sequence: Synthetic oligonucleotide
ucaguucacucagcaggcu

SEQ ID NO: 2613 - RNA, 19 nt, Artificial Sequence
  Description of Artificial Sequence: Synthetic oligonucleotide
uucaguucacucagcaggc

SEQ ID NO: 2614 - RNA, 19 nt, Artificial Sequence
  Description of Artificial Sequence: Synthetic oligonucleotide
guucaguucacucagcagg

SEQ ID NO: 2615 - RNA, 19 nt, Artificial Sequence
  Description of Artificial Sequence: Synthetic oligonucleotide
uguucaguucacucagcag

SEQ ID NO: 2616 - RNA, 19 nt, Artificial Sequence
  Description of Artificial Sequence: Synthetic oligonucleotide
uuguucaguucacucagca

SEQ ID NO: 2617 - RNA, 19 nt, Artificial Sequence
  Description of Artificial Sequence: Synthetic oligonucleotide
cuuguucaguucacucagc

SEQ ID NO: 2618 - RNA, 19 nt, Artificial Sequence
  Description of Artificial Sequence: Synthetic oligonucleotide
ucuuguucaguucacucag

SEQ ID NO: 2619 - RNA, 19 nt, Artificial Sequence
  Description of Artificial Sequence: Synthetic oligonucleotide
uucuuguucaguucacuca

SEQ ID NO: 2620 - RNA, 19 nt, Artificial Sequence
  Description of Artificial Sequence: Synthetic oligonucleotide
cuucuuguucaguucacuc

SEQ ID NO: 2621 - RNA, 19 nt, Artificial Sequence
  Description of Artificial Sequence: Synthetic oligonucleotide
gcuucuuguucaguucacu

SEQ ID NO: 2622 - RNA, 19 nt, Artificial Sequence
  Description of Artificial Sequence: Synthetic oligonucleotide
ugcuucuuguucaguucac

SEQ ID NO: 2623 - RNA, 19 nt, Artificial Sequence
  Description of Artificial Sequence: Synthetic oligonucleotide
cugcuucuuguucaguuca

SEQ ID NO: 2624 - RNA, 19 nt, Artificial Sequence
  Description of Artificial Sequence: Synthetic oligonucleotide
ccugcuucuuguucaguuc

SEQ ID NO: 2625 - RNA, 19 nt, Artificial Sequence
  Description of Artificial Sequence: Synthetic oligonucleotide
uccugcuucuuguucaguu

SEQ ID NO: 2626 - RNA, 19 nt, Artificial Sequence
  Description of Artificial Sequence: Synthetic oligonucleotide
cuccugcuucuuguucagu

SEQ ID NO: 2627 - RNA, 19 nt, Artificial Sequence
  Description of Artificial Sequence: Synthetic oligonucleotide
ucuccugcuucuuguucag

SEQ ID NO: 2628 - RNA, 19 nt, Artificial Sequence
  Description of Artificial Sequence: Synthetic oligonucleotide
cucuccugcuucuuguuca

SEQ ID NO: 2629 - RNA, 19 nt, Artificial Sequence
  Description of Artificial Sequence: Synthetic oligonucleotide
ccucuccugcuucuuguuc

SEQ ID NO: 2630 - RNA, 19 nt, Artificial Sequence
  Description of Artificial Sequence: Synthetic oligonucleotide
cccucuccugcuucuuguu

SEQ ID NO: 2631 - RNA, 19 nt, Artificial Sequence
  Description of Artificial Sequence: Synthetic oligonucleotide
ucccucuccugcuucuugu

SEQ ID NO: 2632 - RNA, 19 nt, Artificial Sequence
  Description of Artificial Sequence: Synthetic oligonucleotide
gucccucuccugcuucuug

SEQ ID NO: 2633 - RNA, 19 nt, Artificial Sequence
  Description of Artificial Sequence: Synthetic oligonucleotide
agucccucuccugcuucuu

SEQ ID NO: 2634 - RNA, 19 nt, Artificial Sequence
  Description of Artificial Sequence: Synthetic oligonucleotide
cagucccucuccugcuucu

SEQ ID NO: 2635 - RNA, 19 nt, Artificial Sequence
  Description of Artificial Sequence: Synthetic oligonucleotide
ccagucccucuccugcuuc

SEQ ID NO: 2636 - RNA, 19 nt, Artificial Sequence
  Description of Artificial Sequence: Synthetic oligonucleotide
cccagucccucuccugcuu

SEQ ID NO: 2637 - RNA, 19 nt, Artificial Sequence
  Description of Artificial Sequence: Synthetic oligonucleotide
acccagucccucuccugcu

SEQ ID NO: 2638 - RNA, 19 nt, Artificial Sequence
  Description of Artificial Sequence: Synthetic oligonucleotide
gacccagucccucuccugc

SEQ ID NO: 2639 - RNA, 19 nt, Artificial Sequence
  Description of Artificial Sequence: Synthetic oligonucleotide
ugacccagucccucuccug

SEQ ID NO: 2640 - RNA, 19 nt, Artificial Sequence
  Description of Artificial Sequence: Synthetic oligonucleotide
cugacccagucccucuccu

SEQ ID NO: 2641 - RNA, 19 nt, Artificial Sequence
  Description of Artificial Sequence: Synthetic oligonucleotide
gcugacccagucccucucc

SEQ ID NO: 2642 - RNA, 19 nt, Artificial Sequence
  Description of Artificial Sequence: Synthetic oligonucleotide
cgcugacccagucccucuc

SEQ ID NO: 2643 - RNA, 19 nt, Artificial Sequence
  Description of Artificial Sequence: Synthetic oligonucleotide
acgcugacccagucccucu

SEQ ID NO: 2644 - RNA, 19 nt, Artificial Sequence
  Description of Artificial Sequence: Synthetic oligonucleotide
cacgcugacccagucccuc

SEQ ID NO: 2645 - RNA, 19 nt, Artificial Sequence
  Description of Artificial Sequence: Synthetic oligonucleotide
ccacgcugacccagucccu

SEQ ID NO: 2646 - RNA, 19 nt, Artificial Sequence
  Description of Artificial Sequence: Synthetic oligonucleotide
accacgcugacccaguccc

SEQ ID NO: 2647 - RNA, 19 nt, Artificial Sequence
  Description of Artificial Sequence: Synthetic oligonucleotide
gaccacgcugacccagucc

SEQ ID NO: 2648 - RNA, 19 nt, Artificial Sequence
  Description of Artificial Sequence: Synthetic oligonucleotide
ugaccacgcugacccaguc

SEQ ID NO: 2649 - RNA, 19 nt, Artificial Sequence
  Description of Artificial Sequence: Synthetic oligonucleotide
augaccacgcugacccagu

SEQ ID NO: 2650 - RNA, 19 nt, Artificial Sequence
  Description of Artificial Sequence: Synthetic oligonucleotide
caugaccacgcugacccag

SEQ ID NO: 2651 - RNA, 19 nt, Artificial Sequence
  Description of Artificial Sequence: Synthetic oligonucleotide
gcaugaccacgcugaccca

SEQ ID NO: 2652 - RNA, 19 nt, Artificial Sequence
  Description of Artificial Sequence: Synthetic oligonucleotide
ugcaugaccacgcugaccc

SEQ ID NO: 2653 - RNA, 19 nt, Artificial Sequence
  Description of Artificial Sequence: Synthetic oligonucleotide
cugcaugaccacgcugacc

SEQ ID NO: 2654 - RNA, 19 nt, Artificial Sequence
  Description of Artificial Sequence: Synthetic oligonucleotide
ccugcaugaccacgcugac

SEQ ID NO: 2655 - RNA, 19 nt, Artificial Sequence
  Description of Artificial Sequence: Synthetic oligonucleotide
accugcaugaccacgcuga

SEQ ID NO: 2656 - RNA, 19 nt, Artificial Sequence
  Description of Artificial Sequence: Synthetic oligonucleotide
caccugcaugaccacgcug

SEQ ID NO: 2657 - RNA, 19 nt, Artificial Sequence
  Description of Artificial Sequence: Synthetic oligonucleotide
ucaccugcaugaccacgcu

SEQ ID NO: 2658 - RNA, 19 nt, Artificial Sequence
  Description of Artificial Sequence: Synthetic oligonucleotide
aucaccugcaugaccacgc

SEQ ID NO: 2659 - RNA, 19 nt, Artificial Sequence
  Description of Artificial Sequence: Synthetic oligonucleotide
caucaccugcaugaccacg

SEQ ID NO: 2660 - RNA, 19 nt, Artificial Sequence
  Description of Artificial Sequence: Synthetic oligonucleotide
ccaucaccugcaugaccac

SEQ ID NO: 2661 - RNA, 19 nt, Artificial Sequence
  Description of Artificial Sequence: Synthetic oligonucleotide
uccaucaccugcaugacca

SEQ ID NO: 2662 - RNA, 19 nt, Artificial Sequence
  Description of Artificial Sequence: Synthetic oligonucleotide
cuccaucaccugcaugacc

SEQ ID NO: 2663 - RNA, 19 nt, Artificial Sequence
  Description of Artificial Sequence: Synthetic oligonucleotide
gcuccaucaccugcaugac

SEQ ID NO: 2664 - RNA, 19 nt, Artificial Sequence
  Description of Artificial Sequence: Synthetic oligonucleotide
agcuccaucaccugcauga

SEQ ID NO: 2665 - RNA, 19 nt, Artificial Sequence
  Description of Artificial Sequence: Synthetic oligonucleotide
cagcuccaucaccugcaug

SEQ ID NO: 2666 - RNA, 19 nt, Artificial Sequence
  Description of Artificial Sequence: Synthetic oligonucleotide
ccagcuccaucaccugcau

SEQ ID NO: 2667 - RNA, 19 nt, Artificial Sequence
  Description of Artificial Sequence: Synthetic oligonucleotide
uccagcuccaucaccugca

SEQ ID NO: 2668 - RNA, 19 nt, Artificial Sequence
  Description of Artificial Sequence: Synthetic oligonucleotide
cuccagcuccaucaccugc

SEQ ID NO: 2669 - RNA, 19 nt, Artificial Sequence
  Description of Artificial Sequence: Synthetic oligonucleotide
ucuccagcuccaucaccug

SEQ ID NO: 2670 - RNA, 19 nt, Artificial Sequence
  Description of Artificial Sequence: Synthetic oligonucleotide
cucuccagcuccaucaccu

SEQ ID NO: 2671 - RNA, 19 nt, Artificial Sequence
  Description of Artificial Sequence: Synthetic oligonucleotide
gcucuccagcuccaucacc

SEQ ID NO: 2672 - RNA, 19 nt, Artificial Sequence
  Description of Artificial Sequence: Synthetic oligonucleotide
ugcucuccagcuccaucac

SEQ ID NO: 2673 - RNA, 19 nt, Artificial Sequence
  Description of Artificial Sequence: Synthetic oligonucleotide
uugcucuccagcuccauca

SEQ ID NO: 2674 - RNA, 19 nt, Artificial Sequence
  Description of Artificial Sequence: Synthetic oligonucleotide
guugcucuccagcuccauc

SEQ ID NO: 2675 - RNA, 19 nt, Artificial Sequence
  Description of Artificial Sequence: Synthetic oligonucleotide
uguugcucuccagcuccau

SEQ ID NO: 2676 - RNA, 19 nt, Artificial Sequence
  Description of Artificial Sequence: Synthetic oligonucleotide
cuguugcucuccagcucca

SEQ ID NO: 2677 - RNA, 19 nt, Artificial Sequence
  Description of Artificial Sequence: Synthetic oligonucleotide
gcuguugcucuccagcucc

SEQ ID NO: 2678 - RNA, 19 nt, Artificial Sequence
  Description of Artificial Sequence: Synthetic oligonucleotide
ugcuguugcucuccagcuc

SEQ ID NO: 2679 - RNA, 19 nt, Artificial Sequence
  Description of Artificial Sequence: Synthetic oligonucleotide
uugcuguugcucuccagcu

SEQ ID NO: 2680 - RNA, 19 nt, Artificial Sequence
  Description of Artificial Sequence: Synthetic oligonucleotide
cuugcuguugcucuccagc

SEQ ID NO: 2681 - RNA, 19 nt, Artificial Sequence
  Description of Artificial Sequence: Synthetic oligonucleotide
gcuugcuguugcucuccag

SEQ ID NO: 2682 - RNA, 19 nt, Artificial Sequence
  Description of Artificial Sequence: Synthetic oligonucleotide
cgcuugcuguugcucucca

SEQ ID NO: 2683 - RNA, 19 nt, Artificial Sequence
  Description of Artificial Sequence: Synthetic oligonucleotide
gcgcuugcuguugcucucc

SEQ ID NO: 2684 - RNA, 19 nt, Artificial Sequence
  Description of Artificial Sequence: Synthetic oligonucleotide
ugcgcuugcuguugcucuc

SEQ ID NO: 2685 - RNA, 19 nt, Artificial Sequence
  Description of Artificial Sequence: Synthetic oligonucleotide
augcgcuugcuguugcucu

SEQ ID NO: 2686 - RNA, 19 nt, Artificial Sequence
  Description of Artificial Sequence: Synthetic oligonucleotide
caugcgcuugcuguugcuc

SEQ ID NO: 2687 - RNA, 19 nt, Artificial Sequence
  Description of Artificial Sequence: Synthetic oligonucleotide
ccaugcgcuugcuguugcu

SEQ ID NO: 2688 - RNA, 19 nt, Artificial Sequence
  Description of Artificial Sequence: Synthetic oligonucleotide
uccaugcgcuugcuguugc

SEQ ID NO: 2689 - RNA, 19 nt, Artificial Sequence
  Description of Artificial Sequence: Synthetic oligonucleotide
cuccaugcgcuugcuguug

SEQ ID NO: 2690 - RNA, 19 nt, Artificial Sequence
  Description of Artificial Sequence: Synthetic oligonucleotide
acuccaugcgcuugcuguu

SEQ ID NO: 2691 - RNA, 19 nt, Artificial Sequence
  Description of Artificial Sequence: Synthetic oligonucleotide
gacuccaugcgcuugcugu

SEQ ID NO: 2692 - RNA, 19 nt, Artificial Sequence
  Description of Artificial Sequence: Synthetic oligonucleotide
cgacuccaugcgcuugcug

SEQ ID NO: 2693 - RNA, 19 nt, Artificial Sequence
  Description of Artificial Sequence: Synthetic oligonucleotide
gcgacuccaugcgcuugcu

SEQ ID NO: 2694 - RNA, 19 nt, Artificial Sequence
  Description of Artificial Sequence: Synthetic oligonucleotide
cgcgacuccaugcgcuugc

SEQ ID NO: 2695 - RNA, 19 nt, Artificial Sequence
  Description of Artificial Sequence: Synthetic oligonucleotide
ccgcgacuccaugcgcuug

SEQ ID NO: 2696 - RNA, 19 nt, Artificial Sequence
  Description of Artificial Sequence: Synthetic oligonucleotide
gccgcgacuccaugcgcuu

SEQ ID NO: 2697 - RNA, 19 nt, Artificial Sequence
  Description of Artificial Sequence: Synthetic oligonucleotide
agccgcgacuccaugcgcu

SEQ ID NO: 2698 - RNA, 19 nt, Artificial Sequence
  Description of Artificial Sequence: Synthetic oligonucleotide
gagccgcgacuccaugcgc

SEQ ID NO: 2699 - RNA, 19 nt, Artificial Sequence
  Description of Artificial Sequence: Synthetic oligonucleotide
ugagccgcgacuccaugcg

SEQ ID NO: 2700 - RNA, 19 nt, Artificial Sequence
  Description of Artificial Sequence: Synthetic oligonucleotide
gugagccgcgacuccaugc

SEQ ID NO: 2701 - RNA, 19 nt, Artificial Sequence
  Description of Artificial Sequence: Synthetic oligonucleotide
ugugagccgcgacuccaug

SEQ ID NO: 2702 - RNA, 19 nt, Artificial Sequence
  Description of Artificial Sequence: Synthetic oligonucleotide
cugugagccgcgacuccau

SEQ ID NO: 2703 - RNA, 19 nt, Artificial Sequence
  Description of Artificial Sequence: Synthetic oligonucleotide
ucugugagccgcgacucca

SEQ ID NO: 2704 - RNA, 19 nt, Artificial Sequence
  Description of Artificial Sequence: Synthetic oligonucleotide
aucugugagccgcgacucc

SEQ ID NO: 2705 - RNA, 19 nt, Artificial Sequence
  Description of Artificial Sequence: Synthetic oligonucleotide
caucugugagccgcgacuc

SEQ ID NO: 2706 - RNA, 19 nt, Artificial Sequence
  Description of Artificial Sequence: Synthetic oligonucleotide
gcaucugugagccgcgacu

SEQ ID NO: 2707 - RNA, 19 nt, Artificial Sequence
  Description of Artificial Sequence: Synthetic oligonucleotide
agcaucugugagccgcgac

SEQ ID NO: 2708 - RNA, 19 nt, Artificial Sequence
  Description of Artificial Sequence: Synthetic oligonucleotide
cagcaucugugagccgcga

SEQ ID NO: 2709 - RNA, 19 nt, Artificial Sequence
  Description of Artificial Sequence: Synthetic oligonucleotide
ucagcaucugugagccgcg

SEQ ID NO: 2710 - RNA, 19 nt, Artificial Sequence
  Description of Artificial Sequence: Synthetic oligonucleotide
cucagcaucugugagccgc

SEQ ID NO: 2711 - RNA, 19 nt, Artificial Sequence
  Description of Artificial Sequence: Synthetic oligonucleotide
ucucagcaucugugagccg

SEQ ID NO: 2712 - RNA, 19 nt, Artificial Sequence
  Description of Artificial Sequence: Synthetic oligonucleotide
cucucagcaucugugagcc

SEQ ID NO: 2713 - RNA, 19 nt, Artificial Sequence
  Description of Artificial Sequence: Synthetic oligonucleotide
gcucucagcaucugugagc

SEQ ID NO: 2714 - RNA, 19 nt, Artificial Sequence
  Description of Artificial Sequence: Synthetic oligonucleotide
ugcucucagcaucugugag

SEQ ID NO: 2715 - RNA, 19 nt, Artificial Sequence
  Description of Artificial Sequence: Synthetic oligonucleotide
uugcucucagcaucuguga

SEQ ID NO: 2716 - RNA, 19 nt, Artificial Sequence
  Description of Artificial Sequence: Synthetic oligonucleotide
cuugcucucagcaucugug

SEQ ID NO: 2717 - RNA, 19 nt, Artificial Sequence
  Description of Artificial Sequence: Synthetic oligonucleotide
acuugcucucagcaucugu

SEQ ID NO: 2718 - RNA, 19 nt, Artificial Sequence
  Description of Artificial Sequence: Synthetic oligonucleotide
uacuugcucucagcaucug

SEQ ID NO: 2719 - RNA, 19 nt, Artificial Sequence
  Description of Artificial Sequence: Synthetic oligonucleotide
guacuugcucucagcaucu

SEQ ID NO: 2720 - RNA, 19 nt, Artificial Sequence
  Description of Artificial Sequence: Synthetic oligonucleotide
aguacuugcucucagcauc

SEQ ID NO: 2721 - RNA, 19 nt, Artificial Sequence
  Description of Artificial Sequence: Synthetic oligonucleotide
gaguacuugcucucagcau

SEQ ID NO: 2722 - RNA, 19 nt, Artificial Sequence
  Description of Artificial Sequence: Synthetic oligonucleotide
ggaguacuugcucucagca

SEQ ID NO: 2723 - RNA, 19 nt, Artificial Sequence
  Description of Artificial Sequence: Synthetic oligonucleotide
cggaguacuugcucucagc

SEQ ID NO: 2724 - RNA, 19 nt, Artificial Sequence
  Description of Artificial Sequence: Synthetic oligonucleotide
ucggaguacuugcucucag

SEQ ID NO: 2725 - RNA, 19 nt, Artificial Sequence
  Description of Artificial Sequence: Synthetic oligonucleotide
cucggaguacuugcucuca

SEQ ID NO: 2726 - RNA, 19 nt, Artificial Sequence
  Description of Artificial Sequence: Synthetic oligonucleotide
ucucggaguacuugcucuc

SEQ ID NO: 2727 - RNA, 19 nt, Artificial Sequence
  Description of Artificial Sequence: Synthetic oligonucleotide
aucucggaguacuugcucu

SEQ ID NO: 2728 - RNA, 19 nt, Artificial Sequence
  Description of Artificial Sequence: Synthetic oligonucleotide
caucucggaguacuugcuc

SEQ ID NO: 2729 - RNA, 19 nt, Artificial Sequence
  Description of Artificial Sequence: Synthetic oligonucleotide
ucaucucggaguacuugcu

SEQ ID NO: 2730 - RNA, 19 nt, Artificial Sequence
  Description of Artificial Sequence: Synthetic oligonucleotide
uucaucucggaguacuugc

SEQ ID NO: 2731 - RNA, 19 nt, Artificial Sequence
  Description of Artificial Sequence: Synthetic oligonucleotide
guucaucucggaguacuug

SEQ ID NO: 2732 - RNA, 19 nt, Artificial Sequence
  Description of Artificial Sequence: Synthetic oligonucleotide
uguucaucucggaguacuu

SEQ ID NO: 2733 - RNA, 19 nt, Artificial Sequence
  Description of Artificial Sequence: Synthetic oligonucleotide
uuguucaucucggaguacu

SEQ ID NO: 2734 - RNA, 19 nt, Artificial Sequence
  Description of Artificial Sequence: Synthetic oligonucleotide
guuguucaucucggaguac

SEQ ID NO: 2735 - RNA, 19 nt, Artificial Sequence
  Description of Artificial Sequence: Synthetic oligonucleotide
gguuguucaucucggagua

SEQ ID NO: 2736 - RNA, 19 nt, Artificial Sequence
  Description of Artificial Sequence: Synthetic oligonucleotide
ugguuguucaucucggagu

SEQ ID NO: 2737 - RNA, 19 nt, Artificial Sequence
  Description of Artificial Sequence: Synthetic oligonucleotide
uugguuguucaucucggag

SEQ ID NO: 2738 - RNA, 19 nt, Artificial Sequence
  Description of Artificial Sequence: Synthetic oligonucleotide
uuugguuguucaucucgga

SEQ ID NO: 2739 - RNA, 19 nt, Artificial Sequence
  Description of Artificial Sequence: Synthetic oligonucleotide
auuugguuguucaucucgg

SEQ ID NO: 2740 - RNA, 19 nt, Artificial Sequence
  Description of Artificial Sequence: Synthetic oligonucleotide
aauuugguuguucaucucg

SEQ ID NO: 2741 - RNA, 19 nt, Artificial Sequence
  Description of Artificial Sequence: Synthetic oligonucleotide
caauuugguuguucaucuc

SEQ ID NO: 2742 - RNA, 19 nt, Artificial Sequence
  Description of Artificial Sequence: Synthetic oligonucleotide
ucaauuugguuguucaucu

SEQ ID NO: 2743 - RNA, 19 nt, Artificial Sequence
  Description of Artificial Sequence: Synthetic oligonucleotide
gucaauuugguuguucauc

SEQ ID NO: 2744 - RNA, 19 nt, Artificial Sequence
  Description of Artificial Sequence: Synthetic oligonucleotide
ugucaauuugguuguucau

SEQ ID NO: 2745 - RNA, 19 nt, Artificial Sequence
  Description of Artificial Sequence: Synthetic oligonucleotide
augucaauuugguuguuca

SEQ ID NO: 2746 - RNA, 19 nt, Artificial Sequence
  Description of Artificial Sequence: Synthetic oligonucleotide
gaugucaauuugguuguuc

SEQ ID NO: 2747 - RNA, 19 nt, Artificial Sequence
  Description of Artificial Sequence: Synthetic oligonucleotide
ugaugucaauuugguuguu

SEQ ID NO: 2748 - RNA, 19 nt, Artificial Sequence
  Description of Artificial Sequence: Synthetic oligonucleotide
augaugucaauuugguugu

SEQ ID NO: 2749 - RNA, 19 nt, Artificial Sequence
  Description of Artificial Sequence: Synthetic oligonucleotide
caugaugucaauuugguug

SEQ ID NO: 2750 - RNA, 19 nt, Artificial Sequence
  Description of Artificial Sequence: Synthetic oligonucleotide
gcaugaugucaauuugguu

SEQ ID NO: 2751 - RNA, 19 nt, Artificial Sequence
  Description of Artificial Sequence: Synthetic oligonucleotide
ugcaugaugucaauuuggu

SEQ ID NO: 2752 - RNA, 19 nt, Artificial Sequence
  Description of Artificial Sequence: Synthetic oligonucleotide
cugcaugaugucaauuugg

SEQ ID NO: 2753 - RNA, 19 nt, Artificial Sequence
  Description of Artificial Sequence: Synthetic oligonucleotide
gcugcaugaugucaauuug

SEQ ID NO: 2754 - RNA, 19 nt, Artificial Sequence
  Description of Artificial Sequence: Synthetic oligonucleotide
agcugcaugaugucaauuu

SEQ ID NO: 2755 - RNA, 19 nt, Artificial Sequence
  Description of Artificial Sequence: Synthetic oligonucleotide
cagcugcaugaugucaauu

SEQ ID NO: 2756 - RNA, 19 nt, Artificial Sequence
  Description of Artificial Sequence: Synthetic oligonucleotide
gcagcugcaugaugucaau

SEQ ID NO: 2757 - RNA, 19 nt, Artificial Sequence
  Description of Artificial Sequence: Synthetic oligonucleotide
ugcagcugcaugaugucaa

SEQ ID NO: 2758 - RNA, 19 nt, Artificial Sequence
  Description of Artificial Sequence: Synthetic oligonucleotide
cugcagcugcaugauguca

SEQ ID NO: 2759 - RNA, 19 nt, Artificial Sequence
  Description of Artificial Sequence: Synthetic oligonucleotide
ccugcagcugcaugauguc

SEQ ID NO: 2760 - RNA, 19 nt, Artificial Sequence
  Description of Artificial Sequence: Synthetic oligonucleotide
gccugcagcugcaugaugu

SEQ ID NO: 2761 - RNA, 19 nt, Artificial Sequence
  Description of Artificial Sequence: Synthetic oligonucleotide
ugccugcagcugcaugaug

SEQ ID NO: 2762 - RNA, 19 nt, Artificial Sequence
  Description of Artificial Sequence: Synthetic oligonucleotide
cugccugcagcugcaugau

SEQ ID NO: 2763 - RNA, 19 nt, Artificial Sequence
  Description of Artificial Sequence: Synthetic oligonucleotide
gcugccugcagcugcauga

SEQ ID NO: 2764 - RNA, 19 nt, Artificial Sequence
  Description of Artificial Sequence: Synthetic oligonucleotide
ugcugccugcagcugcaug

SEQ ID NO: 2765 - RNA, 19 nt, Artificial Sequence
  Description of Artificial Sequence: Synthetic oligonucleotide
gugcugccugcagcugcau

SEQ ID NO: 2766 - RNA, 19 nt, Artificial Sequence
  Description of Artificial Sequence: Synthetic oligonucleotide
ugugcugccugcagcugca

SEQ ID NO: 2767 - RNA, 19 nt, Artificial Sequence
  Description of Artificial Sequence: Synthetic oligonucleotide
cugugcugccugcagcugc

SEQ ID NO: 2768 - RNA, 19 nt, Artificial Sequence
  Description of Artificial Sequence: Synthetic oligonucleotide
ucugugcugccugcagcug

SEQ ID NO: 2769 - RNA, 19 nt, Artificial Sequence
  Description of Artificial Sequence: Synthetic oligonucleotide
gucugugcugccugcagcu

SEQ ID NO: 2770 - RNA, 19 nt, Artificial Sequence
  Description of Artificial Sequence: Synthetic oligonucleotide
cgucugugcugccugcagc

SEQ ID NO: 2771 - RNA, 19 nt, Artificial Sequence
  Description of Artificial Sequence: Synthetic oligonucleotide
ccgucugugcugccugcag

SEQ ID NO: 2772 - RNA, 19 nt, Artificial Sequence
  Description of Artificial Sequence: Synthetic oligonucleotide
accgucugugcugccugca

SEQ ID NO: 2773 - RNA, 19 nt, Artificial Sequence
  Description of Artificial Sequence: Synthetic oligonucleotide
gaccgucugugcugccugc

SEQ ID NO: 2774 - RNA, 19 nt, Artificial Sequence
  Description of Artificial Sequence: Synthetic oligonucleotide
ugaccgucugugcugccug

SEQ ID NO: 2775 - RNA, 19 nt, Artificial Sequence
  Description of Artificial Sequence: Synthetic oligonucleotide
gugaccgucugugcugccu

SEQ ID NO: 2776 - RNA, 19 nt, Artificial Sequence
  Description of Artificial Sequence: Synthetic oligonucleotide
agugaccgucugugcugcc

SEQ ID NO: 2777 - RNA, 19 nt, Artificial Sequence
  Description of Artificial Sequence: Synthetic oligonucleotide
gagugaccgucugugcugc

SEQ ID NO: 2778 - RNA, 19 nt, Artificial Sequence
  Description of Artificial Sequence: Synthetic oligonucleotide
ugagugaccgucugugcug

SEQ ID NO: 2779 - RNA, 19 nt, Artificial Sequence
  Description of Artificial Sequence: Synthetic oligonucleotide
cugagugaccgucugugcu

SEQ ID NO: 2780 - RNA, 19 nt, Artificial Sequence
  Description of Artificial Sequence: Synthetic oligonucleotide
ucugagugaccgucugugc

SEQ ID NO: 2781 - RNA, 19 nt, Artificial Sequence
  Description of Artificial Sequence: Synthetic oligonucleotide
gucugagugaccgucugug

SEQ ID NO: 2782 - RNA, 19 nt, Artificial Sequence
  Description of Artificial Sequence: Synthetic oligonucleotide
ggucugagugaccgucugu

SEQ ID NO: 2783 - RNA, 19 nt, Artificial Sequence
  Description of Artificial Sequence: Synthetic oligonucleotide
aggucugagugaccgucug

SEQ ID NO: 2784 - RNA, 19 nt, Artificial Sequence
  Description of Artificial Sequence: Synthetic oligonucleotide
gaggucugagugaccgucu

SEQ ID NO: 2785 - RNA, 19 nt, Artificial Sequence
  Description of Artificial Sequence: Synthetic oligonucleotide
ggaggucugagugaccguc

SEQ ID NO: 2786 - RNA, 19 nt, Artificial Sequence
  Description of Artificial Sequence: Synthetic oligonucleotide
cggaggucugagugaccgu

SEQ ID NO: 2787 - RNA, 19 nt, Artificial Sequence
  Description of Artificial Sequence: Synthetic oligonucleotide
gcggaggucugagugaccg

SEQ ID NO: 2788 - RNA, 19 nt, Artificial Sequence
  Description of Artificial Sequence: Synthetic oligonucleotide
ugcggaggucugagugacc

SEQ ID NO: 2789 - RNA, 19 nt, Artificial Sequence
  Description of Artificial Sequence: Synthetic oligonucleotide
cugcggaggucugagugac

SEQ ID NO: 2790 - RNA, 19 nt, Artificial Sequence
  Description of Artificial Sequence: Synthetic oligonucleotide
ucugcggaggucugaguga

SEQ ID NO: 2791 - RNA, 19 nt, Artificial Sequence
  Description of Artificial Sequence: Synthetic oligonucleotide
aucugcggaggucugagug

SEQ ID NO: 2792 - RNA, 19 nt, Artificial Sequence
  Description of Artificial Sequence: Synthetic oligonucleotide
caucugcggaggucugagu

SEQ ID NO: 2793 - RNA, 19 nt, Artificial Sequence
  Description of Artificial Sequence: Synthetic oligonucleotide
gcaucugcggaggucugag

SEQ ID NO: 2794 - RNA, 19 nt, Artificial Sequence
  Description of Artificial Sequence: Synthetic oligonucleotide
ggcaucugcggaggucuga

SEQ ID NO: 2795 - RNA, 19 nt, Artificial Sequence
  Description of Artificial Sequence: Synthetic oligonucleotide
uggcaucugcggaggucug

SEQ ID NO: 2796 - RNA, 19 nt, Artificial Sequence
  Description of Artificial Sequence: Synthetic oligonucleotide
auggcaucugcggaggucu

SEQ ID NO: 2797 - RNA, 19 nt, Artificial Sequence
  Description of Artificial Sequence: Synthetic oligonucleotide
gauggcaucugcggagguc

SEQ ID NO: 2798 - RNA, 19 nt, Artificial Sequence
  Description of Artificial Sequence: Synthetic oligonucleotide
agauggcaucugcggaggu

SEQ ID NO: 2799 - RNA, 19 nt, Artificial Sequence
  Description of Artificial Sequence: Synthetic oligonucleotide
uagauggcaucugcggagg

SEQ ID NO: 2800 - RNA, 19 nt, Artificial Sequence
  Description of Artificial Sequence: Synthetic oligonucleotide
guagauggcaucugcggag

SEQ ID NO: 2801 - RNA, 19 nt, Artificial Sequence
  Description of Artificial Sequence: Synthetic oligonucleotide
cguagauggcaucugcgga

SEQ ID NO: 2802 - RNA, 19 nt, Artificial Sequence
  Description of Artificial Sequence: Synthetic oligonucleotide
ucguagauggcaucugcgg

SEQ ID NO: 2803 - RNA, 19 nt, Artificial Sequence
  Description of Artificial Sequence: Synthetic oligonucleotide
gucguagauggcaucugcg

SEQ ID NO: 2804 - RNA, 19 nt, Artificial Sequence
  Description of Artificial Sequence: Synthetic oligonucleotide
agucguagauggcaucugc

SEQ ID NO: 2805 - RNA, 19 nt, Artificial Sequence
  Description of Artificial Sequence: Synthetic oligonucleotide
cagucguagauggcaucug

SEQ ID NO: 2806 - RNA, 19 nt, Artificial Sequence
  Description of Artificial Sequence: Synthetic oligonucleotide
gcagucguagauggcaucu

SEQ ID NO: 2807 - RNA, 19 nt, Artificial Sequence
  Description of Artificial Sequence: Synthetic oligonucleotide
agcagucguagauggcauc

SEQ ID NO: 2808 - RNA, 19 nt, Artificial Sequence
  Description of Artificial Sequence: Synthetic oligonucleotide
gagcagucguagauggcau

SEQ ID NO: 2809 - RNA, 19 nt, Artificial Sequence
  Description of Artificial Sequence: Synthetic oligonucleotide
agagcagucguagauggca

SEQ ID NO: 2810 - RNA, 19 nt, Artificial Sequence
  Description of Artificial Sequence: Synthetic oligonucleotide
aagagcagucguagauggc

SEQ ID NO: 2811 - RNA, 19 nt, Artificial Sequence
  Description of Artificial Sequence: Synthetic oligonucleotide
gaagagcagucguagaugg

SEQ ID NO: 2812 - RNA, 19 nt, Artificial Sequence
  Description of Artificial Sequence: Synthetic oligonucleotide
ggaagagcagucguagaug

SEQ ID NO: 2813 - RNA, 19 nt, Artificial Sequence
  Description of Artificial Sequence: Synthetic oligonucleotide
gggaagagcagucguagau

SEQ ID NO: 2814 - RNA, 19 nt, Artificial Sequence
  Description of Artificial Sequence: Synthetic oligonucleotide
agggaagagcagucguaga

SEQ ID NO: 2815 - RNA, 19 nt, Artificial Sequence
  Description of Artificial Sequence: Synthetic oligonucleotide
gagggaagagcagucguag

SEQ ID NO: 2816 - RNA, 19 nt, Artificial Sequence
  Description of Artificial Sequence: Synthetic oligonucleotide
agagggaagagcagucgua

SEQ ID NO: 2817 - RNA, 19 nt, Artificial Sequence
  Description of Artificial Sequence: Synthetic oligonucleotide
uagagggaagagcagucgu

SEQ ID NO: 2818 - RNA, 19 nt, Artificial Sequence
  Description of Artificial Sequence: Synthetic oligonucleotide
guagagggaagagcagucg

SEQ ID NO: 2819 - RNA, 19 nt, Artificial Sequence
  Description of Artificial Sequence: Synthetic oligonucleotide
gguagagggaagagcaguc

SEQ ID NO: 2820 - RNA, 19 nt, Artificial Sequence
  Description of Artificial Sequence: Synthetic oligonucleotide
ugguagagggaagagcagu

SEQ ID NO: 2821 - RNA, 19 nt, Artificial Sequence
  Description of Artificial Sequence: Synthetic oligonucleotide
cugguagagggaagagcag

SEQ ID NO: 2822 - RNA, 19 nt, Artificial Sequence
  Description of Artificial Sequence: Synthetic oligonucleotide
ucugguagagggaagagca

SEQ ID NO: 2823 - RNA, 19 nt, Artificial Sequence
  Description of Artificial Sequence: Synthetic oligonucleotide
uucugguagagggaagagc

SEQ ID NO: 2824 - RNA, 19 nt, Artificial Sequence
  Description of Artificial Sequence: Synthetic oligonucleotide
cuucugguagagggaagag

SEQ ID NO: 2825 - RNA, 19 nt, Artificial Sequence
  Description of Artificial Sequence: Synthetic oligonucleotide
ucuucugguagagggaaga

SEQ ID NO: 2826 - RNA, 19 nt, Artificial Sequence
  Description of Artificial Sequence: Synthetic oligonucleotide
uucuucugguagagggaag

SEQ ID NO: 2827 - RNA, 19 nt, Artificial Sequence
  Description of Artificial Sequence: Synthetic oligonucleotide
guucuucugguagagggaa

SEQ ID NO: 2828 - RNA, 19 nt, Artificial Sequence
  Description of Artificial Sequence: Synthetic oligonucleotide
aguucuucugguagaggga

SEQ ID NO: 2829 - RNA, 19 nt, Artificial Sequence
  Description of Artificial Sequence: Synthetic oligonucleotide
uaguucuucugguagaggg

SEQ ID NO: 2830 - RNA, 19 nt, Artificial Sequence
  Description of Artificial Sequence: Synthetic oligonucleotide
guaguucuucugguagagg

SEQ ID NO: 2831 - RNA, 19 nt, Artificial Sequence
  Description of Artificial Sequence: Synthetic oligonucleotide
gguaguucuucugguagag

SEQ ID NO: 2832 - RNA, 19 nt, Artificial Sequence
  Description of Artificial Sequence: Synthetic oligonucleotide
cgguaguucuucugguaga

SEQ ID NO: 2833 - RNA, 19 nt, Artificial Sequence
  Description of Artificial Sequence: Synthetic oligonucleotide
gcgguaguucuucugguag

SEQ ID NO: 2834 - RNA, 19 nt, Artificial Sequence
  Description of Artificial Sequence: Synthetic oligonucleotide
ugcgguaguucuucuggua

SEQ ID NO: 2835 - RNA, 19 nt, Artificial Sequence
  Description of Artificial Sequence: Synthetic oligonucleotide
augcgguaguucuucuggu

SEQ ID NO: 2836 - RNA, 19 nt, Artificial Sequence
  Description of Artificial Sequence: Synthetic oligonucleotide
gaugcgguaguucuucugg

SEQ ID NO: 2837 - RNA, 19 nt, Artificial Sequence
  Description of Artificial Sequence: Synthetic oligonucleotide
agaugcgguaguucuucug

SEQ ID NO: 2838 - RNA, 19 nt, Artificial Sequence
  Description of Artificial Sequence: Synthetic oligonucleotide
gagaugcgguaguucuucu

SEQ ID NO: 2839 - RNA, 19 nt, Artificial Sequence
  Description of Artificial Sequence: Synthetic oligonucleotide
agagaugcgguaguucuuc

SEQ ID NO: 2840 - RNA, 19 nt, Artificial Sequence
  Description of Artificial Sequence: Synthetic oligonucleotide
cagagaugcgguaguucuu

SEQ ID NO: 2841 - RNA, 19 nt, Artificial Sequence
  Description of Artificial Sequence: Synthetic oligonucleotide
ccagagaugcgguaguucu

SEQ ID NO: 2842 - RNA, 19 nt, Artificial Sequence
  Description of Artificial Sequence: Synthetic oligonucleotide
uccagagaugcgguaguuc

SEQ ID NO: 2843 - RNA, 19 nt, Artificial Sequence
  Description of Artificial Sequence: Synthetic oligonucleotide
cuccagagaugcgguaguu

SEQ ID NO: 2844 - RNA, 19 nt, Artificial Sequence
  Description of Artificial Sequence: Synthetic oligonucleotide
acuccagagaugcgguagu

SEQ ID NO: 2845 - RNA, 19 nt, Artificial Sequence
  Description of Artificial Sequence: Synthetic oligonucleotide
cacuccagagaugcgguag

SEQ ID NO: 2846 - RNA, 19 nt, Artificial Sequence
  Description of Artificial Sequence: Synthetic oligonucleotide
acacuccagagaugcggua

SEQ ID NO: 2847 - RNA, 19 nt, Artificial Sequence
  Description of Artificial Sequence: Synthetic oligonucleotide
uacacuccagagaugcggu

SEQ ID NO: 2848 - RNA, 19 nt, Artificial Sequence
  Description of Artificial Sequence: Synthetic oligonucleotide
auacacuccagagaugcgg

SEQ ID NO: 2849 - RNA, 19 nt, Artificial Sequence
  Description of Artificial Sequence: Synthetic oligonucleotide
uauacacuccagagaugcg

SEQ ID NO: 2850 - RNA, 19 nt, Artificial Sequence
  Description of Artificial Sequence: Synthetic oligonucleotide
uuauacacuccagagaugc

SEQ ID NO: 2851 - RNA, 19 nt, Artificial Sequence
  Description of Artificial Sequence: Synthetic oligonucleotide
cuuauacacuccagagaug

SEQ ID NO: 2852 - RNA, 19 nt, Artificial Sequence
  Description of Artificial Sequence: Synthetic oligonucleotide
gcuuauacacuccagagau

SEQ ID NO: 2853 - RNA, 19 nt, Artificial Sequence
  Description of Artificial Sequence: Synthetic oligonucleotide
agcuuauacacuccagaga

SEQ ID NO: 2854 - RNA, 19 nt, Artificial Sequence
  Description of Artificial Sequence: Synthetic oligonucleotide
aagcuuauacacuccagag

SEQ ID NO: 2855 - RNA, 19 nt, Artificial Sequence
  Description of Artificial Sequence: Synthetic oligonucleotide
gaagcuuauacacuccaga

SEQ ID NO: 2856 - RNA, 19 nt, Artificial Sequence
  Description of Artificial Sequence: Synthetic oligonucleotide
ggaagcuuauacacuccag

SEQ ID NO: 2857 - RNA, 19 nt, Artificial Sequence
  Description of Artificial Sequence: Synthetic oligonucleotide
aggaagcuuauacacucca

SEQ ID NO: 2858 - RNA, 19 nt, Artificial Sequence
  Description of Artificial Sequence: Synthetic oligonucleotide
gaggaagcuuauacacucc

SEQ ID NO: 2859 - RNA, 19 nt, Artificial Sequence
  Description of Artificial Sequence: Synthetic oligonucleotide
ggaggaagcuuauacacuc

SEQ ID NO: 2860 - RNA, 19 nt, Artificial Sequence
  Description of Artificial Sequence: Synthetic oligonucleotide
aggaggaagcuuauacacu

SEQ ID NO: 2861 - RNA, 19 nt, Artificial Sequence
  Description of Artificial Sequence: Synthetic oligonucleotide
caggaggaagcuuauacac

SEQ ID NO: 2862 - RNA, 19 nt, Artificial Sequence
  Description of Artificial Sequence: Synthetic oligonucleotide
ucaggaggaagcuuauaca

SEQ ID NO: 2863 - RNA, 19 nt, Artificial Sequence
  Description of Artificial Sequence: Synthetic oligonucleotide
aucaggaggaagcuuauac

SEQ ID NO: 2864 - RNA, 19 nt, Artificial Sequence
  Description of Artificial Sequence: Synthetic oligonucleotide
caucaggaggaagcuuaua

SEQ ID NO: 2865 - RNA, 19 nt, Artificial Sequence
  Description of Artificial Sequence: Synthetic oligonucleotide
ucaucaggaggaagcuuau

SEQ ID NO: 2866 - RNA, 19 nt, Artificial Sequence
  Description of Artificial Sequence: Synthetic oligonucleotide
gucaucaggaggaagcuua

SEQ ID NO: 2867 - RNA, 19 nt, Artificial Sequence
  Description of Artificial Sequence: Synthetic oligonucleotide
agucaucaggaggaagcuu

SEQ ID NO: 2868 - RNA, 19 nt, Artificial Sequence
  Description of Artificial Sequence: Synthetic oligonucleotide
aagucaucaggaggaagcu

SEQ ID NO: 2869 - RNA, 19 nt, Artificial Sequence
  Description of Artificial Sequence: Synthetic oligonucleotide
gaagucaucaggaggaagc

SEQ ID NO: 2870 - RNA, 19 nt, Artificial Sequence
  Description of Artificial Sequence: Synthetic oligonucleotide
ggaagucaucaggaggaag

SEQ ID NO: 2871 - RNA, 19 nt, Artificial Sequence
  Description of Artificial Sequence: Synthetic oligonucleotide
aggaagucaucaggaggaa

SEQ ID NO: 2872 - RNA, 19 nt, Artificial Sequence
  Description of Artificial Sequence: Synthetic oligonucleotide
caggaagucaucaggagga

SEQ ID NO: 2873 - RNA, 19 nt, Artificial Sequence
  Description of Artificial Sequence: Synthetic oligonucleotide
ccaggaagucaucaggagg

SEQ ID NO: 2874 - RNA, 19 nt, Artificial Sequence
  Description of Artificial Sequence: Synthetic oligonucleotide
cccaggaagucaucaggag

SEQ ID NO: 2875 - RNA, 19 nt, Artificial Sequence
  Description of Artificial Sequence: Synthetic oligonucleotide
gcccaggaagucaucagga

SEQ ID NO: 2876 - RNA, 19 nt, Artificial Sequence
  Description of Artificial Sequence: Synthetic oligonucleotide
ugcccaggaagucaucagg

SEQ ID NO: 2877 - RNA, 19 nt, Artificial Sequence
  Description of Artificial Sequence: Synthetic oligonucleotide
cugcccaggaagucaucag

SEQ ID NO: 2878 - RNA, 19 nt, Artificial Sequence
  Description of Artificial Sequence: Synthetic oligonucleotide
gcugcccaggaagucauca

SEQ ID NO: 2879 - RNA, 19 nt, Artificial Sequence
  Description of Artificial Sequence: Synthetic oligonucleotide
ggcugcccaggaagucauc

SEQ ID NO: 2880 - RNA, 19 nt, Artificial Sequence
  Description of Artificial Sequence: Synthetic oligonucleotide
gggcugcccaggaagucau

SEQ ID NO: 2881 - RNA, 19 nt, Artificial Sequence
  Description of Artificial Sequence: Synthetic oligonucleotide
agggcugcccaggaaguca

SEQ ID NO: 2882 - RNA, 19 nt, Artificial Sequence
  Description of Artificial Sequence: Synthetic oligonucleotide
cagggcugcccaggaaguc

SEQ ID NO: 2883 - RNA, 19 nt, Artificial Sequence
  Description of Artificial Sequence: Synthetic oligonucleotide
ucagggcugcccaggaagu

SEQ ID NO: 2884 - RNA, 19 nt, Artificial Sequence
  Description of Artificial Sequence: Synthetic oligonucleotide
uucagggcugcccaggaag

SEQ ID NO: 2885 - RNA, 19 nt, Artificial Sequence
  Description of Artificial Sequence: Synthetic oligonucleotide
guucagggcugcccaggaa

SEQ ID NO: 2886 - RNA, 19 nt, Artificial Sequence
  Description of Artificial Sequence: Synthetic oligonucleotide
aguucagggcugcccagga

SEQ ID NO: 2887 - RNA, 19 nt, Artificial Sequence
  Description of Artificial Sequence: Synthetic oligonucleotide
caguucagggcugcccagg

SEQ ID NO: 2888 - RNA, 19 nt, Artificial Sequence
  Description of Artificial Sequence: Synthetic oligonucleotide
ccaguucagggcugcccag

SEQ ID NO: 2889 - RNA, 19 nt, Artificial Sequence
  Description of Artificial Sequence: Synthetic oligonucleotide
uccaguucagggcugccca

SEQ ID NO: 2890 - RNA, 19 nt, Artificial Sequence
  Description of Artificial Sequence: Synthetic oligonucleotide
cuccaguucagggcugccc

SEQ ID NO: 2891 - RNA, 19 nt, Artificial Sequence
  Description of Artificial Sequence: Synthetic oligonucleotide
ccuccaguucagggcugcc

SEQ ID NO: 2892 - RNA, 19 nt, Artificial Sequence
  Description of Artificial Sequence: Synthetic oligonucleotide
accuccaguucagggcugc

SEQ ID NO: 2893 - RNA, 19 nt, Artificial Sequence
  Description of Artificial Sequence: Synthetic oligonucleotide
caccuccaguucagggcug

SEQ ID NO: 2894 - RNA, 19 nt, Artificial Sequence
  Description of Artificial Sequence: Synthetic oligonucleotide
acaccuccaguucagggcu

SEQ ID NO: 2895 - RNA, 19 nt, Artificial Sequence
  Description of Artificial Sequence: Synthetic oligonucleotide
aacaccuccaguucagggc

SEQ ID NO: 2896 - RNA, 19 nt, Artificial Sequence
  Description of Artificial Sequence: Synthetic oligonucleotide
gaacaccuccaguucaggg

SEQ ID NO: 2897 - RNA, 19 nt, Artificial Sequence
  Description of Artificial Sequence: Synthetic oligonucleotide
agaacaccuccaguucagg

SEQ ID NO: 2898 - RNA, 19 nt, Artificial Sequence
  Description of Artificial Sequence: Synthetic oligonucleotide
cagaacaccuccaguucag

SEQ ID NO: 2899 - RNA, 19 nt, Artificial Sequence
  Description of Artificial Sequence: Synthetic oligonucleotide
acagaacaccuccaguuca

SEQ ID NO: 2900 - RNA, 19 nt, Artificial Sequence
  Description of Artificial Sequence: Synthetic oligonucleotide
cacagaacaccuccaguuc

SEQ ID NO: 2901 - RNA, 19 nt, Artificial Sequence
  Description of Artificial Sequence: Synthetic oligonucleotide
ucacagaacaccuccaguu

SEQ ID NO: 2902 - RNA, 19 nt, Artificial Sequence
  Description of Artificial Sequence: Synthetic oligonucleotide
gucacagaacaccuccagu

SEQ ID NO: 2903 - RNA, 19 nt, Artificial Sequence
  Description of Artificial Sequence: Synthetic oligonucleotide
ugucacagaacaccuccag

SEQ ID NO: 2904 - RNA, 19 nt, Artificial Sequence
  Description of Artificial Sequence: Synthetic oligonucleotide
augucacagaacaccucca

SEQ ID NO: 2905 - RNA, 19 nt, Artificial Sequence
  Description of Artificial Sequence: Synthetic oligonucleotide
caugucacagaacaccucc

SEQ ID NO: 2906 - RNA, 19 nt, Artificial Sequence
  Description of Artificial Sequence: Synthetic oligonucleotide
ccaugucacagaacaccuc

SEQ ID NO: 2907 - RNA, 19 nt, Artificial Sequence
  Description of Artificial Sequence: Synthetic oligonucleotide
uccaugucacagaacaccu

SEQ ID NO: 2908 - RNA, 19 nt, Artificial Sequence
  Description of Artificial Sequence: Synthetic oligonucleotide
cuccaugucacagaacacc

SEQ ID NO: 2909 - RNA, 19 nt, Artificial Sequence
  Description of Artificial Sequence: Synthetic oligonucleotide
ucuccaugucacagaacac

SEQ ID NO: 2910 - RNA, 19 nt, Artificial Sequence
  Description of Artificial Sequence: Synthetic oligonucleotide
gucuccaugucacagaaca

SEQ ID NO: 2911 - RNA, 19 nt, Artificial Sequence
  Description of Artificial Sequence: Synthetic oligonucleotide
agucuccaugucacagaac

SEQ ID NO: 2912 - RNA, 19 nt, Artificial Sequence
  Description of Artificial Sequence: Synthetic oligonucleotide
aagucuccaugucacagaa

SEQ ID NO: 2913 - RNA, 19 nt, Artificial Sequence
  Description of Artificial Sequence: Synthetic oligonucleotide
gaagucuccaugucacaga

SEQ ID NO: 2914 - RNA, 19 nt, Artificial Sequence
  Description of Artificial Sequence: Synthetic oligonucleotide
ugaagucuccaugucacag

SEQ ID NO: 2915 - RNA, 19 nt, Artificial Sequence
  Description of Artificial Sequence: Synthetic oligonucleotide
cugaagucuccaugucaca

SEQ ID NO: 2916 - RNA, 19 nt, Artificial Sequence
  Description of Artificial Sequence: Synthetic oligonucleotide
ccugaagucuccaugucac

SEQ ID NO: 2917 - RNA, 19 nt, Artificial Sequence
  Description of Artificial Sequence: Synthetic oligonucleotide
gccugaagucuccauguca

SEQ ID NO: 2918 - RNA, 19 nt, Artificial Sequence
  Description of Artificial Sequence: Synthetic oligonucleotide
cgccugaagucuccauguc

SEQ ID NO: 2919 - RNA, 19 nt, Artificial Sequence
  Description of Artificial Sequence: Synthetic oligonucleotide
ccgccugaagucuccaugu

SEQ ID NO: 2920 - RNA, 19 nt, Artificial Sequence
  Description of Artificial Sequence: Synthetic oligonucleotide
uccgccugaagucuccaug

SEQ ID NO: 2921 - RNA, 19 nt, Artificial Sequence
  Description of Artificial Sequence: Synthetic oligonucleotide
cuccgccugaagucuccau

SEQ ID NO: 2922 - RNA, 19 nt, Artificial Sequence
  Description of Artificial Sequence: Synthetic oligonucleotide
ccuccgccugaagucucca

SEQ ID NO: 2923 - RNA, 19 nt, Artificial Sequence
  Description of Artificial Sequence: Synthetic oligonucleotide
gccuccgccugaagucucc

SEQ ID NO: 2924 - RNA, 19 nt, Artificial Sequence
  Description of Artificial Sequence: Synthetic oligonucleotide
agccuccgccugaagucuc

SEQ ID NO: 2925 - RNA, 19 nt, Artificial Sequence
  Description of Artificial Sequence: Synthetic oligonucleotide
cagccuccgccugaagucu

SEQ ID NO: 2926 - RNA, 19 nt, Artificial Sequence
  Description of Artificial Sequence: Synthetic oligonucleotide
ccagccuccgccugaaguc

SEQ ID NO: 2927 - RNA, 19 nt, Artificial Sequence
  Description of Artificial Sequence: Synthetic oligonucleotide
uccagccuccgccugaagu

SEQ ID NO: 2928 - RNA, 19 nt, Artificial Sequence
  Description of Artificial Sequence: Synthetic oligonucleotide
guccagccuccgccugaag

SEQ ID NO: 2929 - RNA, 19 nt, Artificial Sequence
  Description of Artificial Sequence: Synthetic oligonucleotide
gguccagccuccgccugaa

SEQ ID NO: 2930 - RNA, 19 nt, Artificial Sequence
  Description of Artificial Sequence: Synthetic oligonucleotide
ugguccagccuccgccuga

SEQ ID NO: 2931 - RNA, 19 nt, Artificial Sequence
  Description of Artificial Sequence: Synthetic oligonucleotide
augguccagccuccgccug

SEQ ID NO: 2932 - RNA, 19 nt, Artificial Sequence
  Description of Artificial Sequence: Synthetic oligonucleotide
gaugguccagccuccgccu

SEQ ID NO: 2933 - RNA, 19 nt, Artificial Sequence
  Description of Artificial Sequence: Synthetic oligonucleotide
ugaugguccagccuccgcc

SEQ ID NO: 2934 - RNA, 19 nt, Artificial Sequence
  Description of Artificial Sequence: Synthetic oligonucleotide
augaugguccagccuccgc

SEQ ID NO: 2935 - RNA, 19 nt, Artificial Sequence
  Description of Artificial Sequence: Synthetic oligonucleotide
gaugaugguccagccuccg

SEQ ID NO: 2936 - RNA, 19 nt, Artificial Sequence
  Description of Artificial Sequence: Synthetic oligonucleotide
ggaugaugguccagccucc

SEQ ID NO: 2937 - RNA, 19 nt, Artificial Sequence
  Description of Artificial Sequence: Synthetic oligonucleotide
uggaugaugguccagccuc

SEQ ID NO: 2938 - RNA, 19 nt, Artificial Sequence
  Description of Artificial Sequence: Synthetic oligonucleotide
cuggaugaugguccagccu

SEQ ID NO: 2939 - RNA, 19 nt, Artificial Sequence
  Description of Artificial Sequence: Synthetic oligonucleotide
ucuggaugaugguccagcc

SEQ ID NO: 2940 - RNA, 19 nt, Artificial Sequence
  Description of Artificial Sequence: Synthetic oligonucleotide
cucuggaugaugguccagc

SEQ ID NO: 2941 - RNA, 19 nt, Artificial Sequence
  Description of Artificial Sequence: Synthetic oligonucleotide
ucucuggaugaugguccag

SEQ ID NO: 2942 - RNA, 19 nt, Artificial Sequence
  Description of Artificial Sequence: Synthetic oligonucleotide
gucucuggaugauggucca

SEQ ID NO: 2943 - RNA, 19 nt, Artificial Sequence
  Description of Artificial Sequence: Synthetic oligonucleotide
cgucucuggaugauggucc

SEQ ID NO: 2944 - RNA, 19 nt, Artificial Sequence
  Description of Artificial Sequence: Synthetic oligonucleotide
ucgucucuggaugaugguc

SEQ ID NO: 2945 - RNA, 19 nt, Artificial Sequence
  Description of Artificial Sequence: Synthetic oligonucleotide
uucgucucuggaugauggu

SEQ ID NO: 2946 - RNA, 19 nt, Artificial Sequence
  Description of Artificial Sequence: Synthetic oligonucleotide
uuucgucucuggaugaugg

SEQ ID NO: 2947 - RNA, 19 nt, Artificial Sequence
  Description of Artificial Sequence: Synthetic oligonucleotide
uuuucgucucuggaugaug

SEQ ID NO: 2948 - RNA, 19 nt, Artificial Sequence
  Description of Artificial Sequence: Synthetic oligonucleotide
uuuuucgucucuggaugau

SEQ ID NO: 2949 - RNA, 19 nt, Artificial Sequence
  Description of Artificial Sequence: Synthetic oligonucleotide
cuuuuucgucucuggauga

SEQ ID NO: 2950 - RNA, 19 nt, Artificial Sequence
  Description of Artificial Sequence: Synthetic oligonucleotide
acuuuuucgucucuggaug

SEQ ID NO: 2951 - RNA, 19 nt, Artificial Sequence
  Description of Artificial Sequence: Synthetic oligonucleotide
cacuuuuucgucucuggau

SEQ ID NO: 2952 - RNA, 19 nt, Artificial Sequence
  Description of Artificial Sequence: Synthetic oligonucleotide
ccacuuuuucgucucugga

SEQ ID NO: 2953 - RNA, 19 nt, Artificial Sequence
  Description of Artificial Sequence: Synthetic oligonucleotide
gccacuuuuucgucucugg

SEQ ID NO: 2954 - RNA, 19 nt, Artificial Sequence
  Description of Artificial Sequence: Synthetic oligonucleotide
ggccacuuuuucgucucug

SEQ ID NO: 2955 - RNA, 19 nt, Artificial Sequence
  Description of Artificial Sequence: Synthetic oligonucleotide
aggccacuuuuucgucucu

SEQ ID NO: 2956 - RNA, 19 nt, Artificial Sequence
  Description of Artificial Sequence: Synthetic oligonucleotide
aaggccacuuuuucgucuc

SEQ ID NO: 2957 - RNA, 19 nt, Artificial Sequence
  Description of Artificial Sequence: Synthetic oligonucleotide
caaggccacuuuuucgucu

SEQ ID NO: 2958 - RNA, 19 nt, Artificial Sequence
  Description of Artificial Sequence: Synthetic oligonucleotide
acaaggccacuuuuucguc

SEQ ID NO: 2959 - RNA, 19 nt, Artificial Sequence
  Description of Artificial Sequence: Synthetic oligonucleotide
gacaaggccacuuuuucgu

SEQ ID NO: 2960 - RNA, 19 nt, Artificial Sequence
  Description of Artificial Sequence: Synthetic oligonucleotide
agacaaggccacuuuuucg

SEQ ID NO: 2961 - RNA, 19 nt, Artificial Sequence
  Description of Artificial Sequence: Synthetic oligonucleotide
gagacaaggccacuuuuuc

SEQ ID NO: 2962 - RNA, 19 nt, Artificial Sequence
  Description of Artificial Sequence: Synthetic oligonucleotide
ggagacaaggccacuuuuu

SEQ ID NO: 2963 - RNA, 19 nt, Artificial Sequence
  Description of Artificial Sequence: Synthetic oligonucleotide
aggagacaaggccacuuuu

SEQ ID NO: 2964 - RNA, 19 nt, Artificial Sequence
  Description of Artificial Sequence: Synthetic oligonucleotide
aaggagacaaggccacuuu

SEQ ID NO: 2965 - RNA, 19 nt, Artificial Sequence
  Description of Artificial Sequence: Synthetic oligonucleotide
gaaggagacaaggccacuu

SEQ ID NO: 2966 - RNA, 19 nt, Artificial Sequence
  Description of Artificial Sequence: Synthetic oligonucleotide
agaaggagacaaggccacu

SEQ ID NO: 2967 - RNA, 19 nt, Artificial Sequence
  Description of Artificial Sequence: Synthetic oligonucleotide
uagaaggagacaaggccac

SEQ ID NO: 2968 - RNA, 19 nt, Artificial Sequence
  Description of Artificial Sequence: Synthetic oligonucleotide
guagaaggagacaaggcca

SEQ ID NO: 2969 - RNA, 19 nt, Artificial Sequence
  Description of Artificial Sequence: Synthetic oligonucleotide
gguagaaggagacaaggcc

SEQ ID NO: 2970 - RNA, 19 nt, Artificial Sequence
  Description of Artificial Sequence: Synthetic oligonucleotide
cgguagaaggagacaaggc

SEQ ID NO: 2971 - RNA, 19 nt, Artificial Sequence
  Description of Artificial Sequence: Synthetic oligonucleotide
ccgguagaaggagacaagg

SEQ ID NO: 2972 - RNA, 19 nt, Artificial Sequence
  Description of Artificial Sequence: Synthetic oligonucleotide
cccgguagaaggagacaag

SEQ ID NO: 2973 - RNA, 19 nt, Artificial Sequence
  Description of Artificial Sequence: Synthetic oligonucleotide
ucccgguagaaggagacaa

SEQ ID NO: 2974 - RNA, 19 nt, Artificial Sequence
  Description of Artificial Sequence: Synthetic oligonucleotide
gucccgguagaaggagaca

SEQ ID NO: 2975 - RNA, 19 nt, Artificial Sequence
  Description of Artificial Sequence: Synthetic oligonucleotide
agucccgguagaaggagac

SEQ ID NO: 2976 - RNA, 19 nt, Artificial Sequence
  Description of Artificial Sequence: Synthetic oligonucleotide
cagucccgguagaaggaga

SEQ ID NO: 2977 - RNA, 19 nt, Artificial Sequence
  Description of Artificial Sequence: Synthetic oligonucleotide
ccagucccgguagaaggag

SEQ ID NO: 2978 - RNA, 19 nt, Artificial Sequence
  Description of Artificial Sequence: Synthetic oligonucleotide
uccagucccgguagaagga

SEQ ID NO: 2979 - RNA, 19 nt, Artificial Sequence
  Description of Artificial Sequence: Synthetic oligonucleotide
uuccagucccgguagaagg

SEQ ID NO: 2980 - RNA, 19 nt, Artificial Sequence
  Description of Artificial Sequence: Synthetic oligonucleotide
cuuccagucccgguagaag

SEQ ID NO: 2981 - RNA, 19 nt, Artificial Sequence
  Description of Artificial Sequence: Synthetic oligonucleotide
gcuuccagucccgguagaa

SEQ ID NO: 2982 - RNA, 19 nt, Artificial Sequence
  Description of Artificial Sequence: Synthetic oligonucleotide
ugcuuccagucccgguaga

SEQ ID NO: 2983 - RNA, 19 nt, Artificial Sequence
  Description of Artificial Sequence: Synthetic oligonucleotide
cugcuuccagucccgguag

SEQ ID NO: 2984 - RNA, 19 nt, Artificial Sequence
  Description of Artificial Sequence: Synthetic oligonucleotide
acugcuuccagucccggua

SEQ ID NO: 2985 - RNA, 19 nt, Artificial Sequence
  Description of Artificial Sequence: Synthetic oligonucleotide
uacugcuuccagucccggu

SEQ ID NO: 2986 - RNA, 19 nt, Artificial Sequence
  Description of Artificial Sequence: Synthetic oligonucleotide
guacugcuuccagucccgg

SEQ ID NO: 2987 - RNA, 19 nt, Artificial Sequence
  Description of Artificial Sequence: Synthetic oligonucleotide
uguacugcuuccagucccg

SEQ ID NO: 2988 - RNA, 19 nt, Artificial Sequence
  Description of Artificial Sequence: Synthetic oligonucleotide
uuguacugcuuccaguccc

SEQ ID NO: 2989 - RNA, 19 nt, Artificial Sequence
  Description of Artificial Sequence: Synthetic oligonucleotide
cuuguacugcuuccagucc

SEQ ID NO: 2990 - RNA, 19 nt, Artificial Sequence
  Description of Artificial Sequence: Synthetic oligonucleotide
gcuuguacugcuuccaguc

SEQ ID NO: 2991 - RNA, 19 nt, Artificial Sequence
  Description of Artificial Sequence: Synthetic oligonucleotide
ugcuuguacugcuuccagu

SEQ ID NO: 2992 - RNA, 19 nt, Artificial Sequence
  Description of Artificial Sequence: Synthetic oligonucleotide
cugcuuguacugcuuccag

SEQ ID NO: 2993 - RNA, 19 nt, Artificial Sequence
  Description of Artificial Sequence: Synthetic oligonucleotide
ccugcuuguacugcuucca

SEQ ID NO: 2994 - RNA, 19 nt, Artificial Sequence
  Description of Artificial Sequence: Synthetic oligonucleotide
cccugcuuguacugcuucc

SEQ ID NO: 2995 - RNA, 19 nt, Artificial Sequence
  Description of Artificial Sequence: Synthetic oligonucleotide
gcccugcuuguacugcuuc

SEQ ID NO: 2996 - RNA, 19 nt, Artificial Sequence
  Description of Artificial Sequence: Synthetic oligonucleotide
agcccugcuuguacugcuu

SEQ ID NO: 2997 - RNA, 19 nt, Artificial Sequence
  Description of Artificial Sequence: Synthetic oligonucleotide
aagcccugcuuguacugcu

SEQ ID NO: 2998 - RNA, 19 nt, Artificial Sequence
  Description of Artificial Sequence: Synthetic oligonucleotide
aaagcccugcuuguacugc

SEQ ID NO: 2999 - RNA, 19 nt, Artificial Sequence
  Description of Artificial Sequence: Synthetic oligonucleotide
caaagcccugcuuguacug

SEQ ID NO: 3000 - RNA, 19 nt, Artificial Sequence
  Description of Artificial Sequence: Synthetic oligonucleotide
ccaaagcccugcuuguacu

SEQ ID NO: 3001 - RNA, 19 nt, Artificial Sequence
  Description of Artificial Sequence: Synthetic oligonucleotide
gccaaagcccugcuuguac

SEQ ID NO: 3002 - RNA, 19 nt, Artificial Sequence
  Description of Artificial Sequence: Synthetic oligonucleotide
ugccaaagcccugcuugua

SEQ ID NO: 3003 - RNA, 19 nt, Artificial Sequence
  Description of Artificial Sequence: Synthetic oligonucleotide
cugccaaagcccugcuugu

SEQ ID NO: 3004 - RNA, 19 nt, Artificial Sequence
  Description of Artificial Sequence: Synthetic oligonucleotide
gcugccaaagcccugcuug

SEQ ID NO: 3005 - RNA, 19 nt, Artificial Sequence
  Description of Artificial Sequence: Synthetic oligonucleotide
ugcugccaaagcccugcuu

SEQ ID NO: 3006 - RNA, 19 nt, Artificial Sequence
  Description of Artificial Sequence: Synthetic oligonucleotide
augcugccaaagcccugcu

SEQ ID NO: 3007 - RNA, 19 nt, Artificial Sequence
  Description of Artificial Sequence: Synthetic oligonucleotide
gaugcugccaaagcccugc

SEQ ID NO: 3008 - RNA, 19 nt, Artificial Sequence
  Description of Artificial Sequence: Synthetic oligonucleotide
ggaugcugccaaagcccug

SEQ ID NO: 3009 - RNA, 19 nt, Artificial Sequence
  Description of Artificial Sequence: Synthetic oligonucleotide
cggaugcugccaaagcccu

SEQ ID NO: 3010 - RNA, 19 nt, Artificial Sequence
  Description of Artificial Sequence: Synthetic oligonucleotide
acggaugcugccaaagccc

SEQ ID NO: 3011 - RNA, 19 nt, Artificial Sequence
  Description of Artificial Sequence: Synthetic oligonucleotide
cacggaugcugccaaagcc

SEQ ID NO: 3012 - RNA, 19 nt, Artificial Sequence
  Description of Artificial Sequence: Synthetic oligonucleotide
ccacggaugcugccaaagc

SEQ ID NO: 3013 - RNA, 19 nt, Artificial Sequence
  Description of Artificial Sequence: Synthetic oligonucleotide
cccacggaugcugccaaag

SEQ ID NO: 3014 - RNA, 19 nt, Artificial Sequence
  Description of Artificial Sequence: Synthetic oligonucleotide
ccccacggaugcugccaaa

SEQ ID NO: 3015 - RNA, 19 nt, Artificial Sequence
  Description of Artificial Sequence: Synthetic oligonucleotide
uccccacggaugcugccaa

SEQ ID NO: 3016 - RNA, 19 nt, Artificial Sequence
  Description of Artificial Sequence: Synthetic oligonucleotide
guccccacggaugcugcca

SEQ ID NO: 3017 - RNA, 19 nt, Artificial Sequence
  Description of Artificial Sequence: Synthetic oligonucleotide
aguccccacggaugcugcc

SEQ ID NO: 3018 - RNA, 19 nt, Artificial Sequence
  Description of Artificial Sequence: Synthetic oligonucleotide
aaguccccacggaugcugc

SEQ ID NO: 3019 - RNA, 19 nt, Artificial Sequence
  Description of Artificial Sequence: Synthetic oligonucleotide
gaaguccccacggaugcug

SEQ ID NO: 3020 - RNA, 19 nt, Artificial Sequence
  Description of Artificial Sequence: Synthetic oligonucleotide
agaaguccccacggaugcu

SEQ ID NO: 3021 - RNA, 19 nt, Artificial Sequence
  Description of Artificial Sequence: Synthetic oligonucleotide
cagaaguccccacggaugc

SEQ ID NO: 3022 - RNA, 19 nt, Artificial Sequence
  Description of Artificial Sequence: Synthetic oligonucleotide
ccagaaguccccacggaug

SEQ ID NO: 3023 - RNA, 19 nt, Artificial Sequence
  Description of Artificial Sequence: Synthetic oligonucleotide
gccagaaguccccacggau

SEQ ID NO: 3024 - RNA, 19 nt, Artificial Sequence
  Description of Artificial Sequence: Synthetic oligonucleotide
agccagaaguccccacgga

SEQ ID NO: 3025 - RNA, 19 nt, Artificial Sequence
  Description of Artificial Sequence: Synthetic oligonucleotide
cagccagaaguccccacgg

SEQ ID NO: 3026 - RNA, 19 nt, Artificial Sequence
  Description of Artificial Sequence: Synthetic oligonucleotide
ccagccagaaguccccacg

SEQ ID NO: 3027 - RNA, 19 nt, Artificial Sequence
  Description of Artificial Sequence: Synthetic oligonucleotide
cccagccagaaguccccac

SEQ ID NO: 3028 - RNA, 19 nt, Artificial Sequence
  Description of Artificial Sequence: Synthetic oligonucleotide
ccccagccagaagucccca

SEQ ID NO: 3029 - RNA, 19 nt, Artificial Sequence
  Description of Artificial Sequence: Synthetic oligonucleotide
uccccagccagaagucccc

SEQ ID NO: 3030 - RNA, 19 nt, Artificial Sequence
  Description of Artificial Sequence: Synthetic oligonucleotide
uuccccagccagaaguccc

SEQ ID NO: 3031 - RNA, 19 nt, Artificial Sequence
  Description of Artificial Sequence: Synthetic oligonucleotide
guuccccagccagaagucc

SEQ ID NO: 3032 - RNA, 19 nt, Artificial Sequence
  Description of Artificial Sequence: Synthetic oligonucleotide
cguuccccagccagaaguc

SEQ ID NO: 3033 - RNA, 19 nt, Artificial Sequence
  Description of Artificial Sequence: Synthetic oligonucleotide
ucguuccccagccagaagu

SEQ ID NO: 3034 - RNA, 19 nt, Artificial Sequence
  Description of Artificial Sequence: Synthetic oligonucleotide
uucguuccccagccagaag

SEQ ID NO: 3035 - RNA, 19 nt, Artificial Sequence
  Description of Artificial Sequence: Synthetic oligonucleotide
guucguuccccagccagaa

SEQ ID NO: 3036 - RNA, 19 nt, Artificial Sequence
  Description of Artificial Sequence: Synthetic oligonucleotide
uguucguuccccagccaga

SEQ ID NO: 3037 - RNA, 19 nt, Artificial Sequence
  Description of Artificial Sequence: Synthetic oligonucleotide
guguucguuccccagccag

SEQ ID NO: 3038 - RNA, 19 nt, Artificial Sequence
  Description of Artificial Sequence: Synthetic oligonucleotide
uguguucguuccccagcca

SEQ ID NO: 3039 - RNA, 19 nt, Artificial Sequence
  Description of Artificial Sequence: Synthetic oligonucleotide
auguguucguuccccagcc

SEQ ID NO: 3040 - RNA, 19 nt, Artificial Sequence
  Description of Artificial Sequence: Synthetic oligonucleotide
gauguguucguuccccagc

SEQ ID NO: 3041 - RNA, 19 nt, Artificial Sequence
  Description of Artificial Sequence: Synthetic oligonucleotide
ggauguguucguuccccag

SEQ ID NO: 3042 - RNA, 19 nt, Artificial Sequence
  Description of Artificial Sequence: Synthetic oligonucleotide
uggauguguucguucccca

SEQ ID NO: 3043 - RNA, 19 nt, Artificial Sequence
  Description of Artificial Sequence: Synthetic oligonucleotide
guggauguguucguucccc

SEQ ID NO: 3044 - RNA, 19 nt, Artificial Sequence
  Description of Artificial Sequence: Synthetic oligonucleotide
gguggauguguucguuccc

SEQ ID NO: 3045 - RNA, 19 nt, Artificial Sequence
  Description of Artificial Sequence: Synthetic oligonucleotide
cgguggauguguucguucc

SEQ ID NO: 3046 - RNA, 19 nt, Artificial Sequence
  Description of Artificial Sequence: Synthetic oligonucleotide
ccgguggauguguucguuc

SEQ ID NO: 3047 - RNA, 19 nt, Artificial Sequence
  Description of Artificial Sequence: Synthetic oligonucleotide
gccgguggauguguucguu

SEQ ID NO: 3048 - RNA, 19 nt, Artificial Sequence
  Description of Artificial Sequence: Synthetic oligonucleotide
agccgguggauguguucgu

SEQ ID NO: 3049 - RNA, 19 nt, Artificial Sequence
  Description of Artificial Sequence: Synthetic oligonucleotide
gagccgguggauguguucg

SEQ ID NO: 3050 - RNA, 19 nt, Artificial Sequence
  Description of Artificial Sequence: Synthetic oligonucleotide
agagccgguggauguguuc

SEQ ID NO: 3051 - RNA, 19 nt, Artificial Sequence
  Description of Artificial Sequence: Synthetic oligonucleotide
gagagccgguggauguguu

SEQ ID NO: 3052 - RNA, 19 nt, Artificial Sequence
  Description of Artificial Sequence: Synthetic oligonucleotide
ggagagccgguggaugugu

SEQ ID NO: 3053 - RNA, 19 nt, Artificial Sequence
  Description of Artificial Sequence: Synthetic oligonucleotide
uggagagccgguggaugug

SEQ ID NO: 3054 - RNA, 19 nt, Artificial Sequence
  Description of Artificial Sequence: Synthetic oligonucleotide
cuggagagccgguggaugu

SEQ ID NO: 3055 - RNA, 19 nt, Artificial Sequence
  Description of Artificial Sequence: Synthetic oligonucleotide
ucuggagagccgguggaug

SEQ ID NO: 3056 - RNA, 19 nt, Artificial Sequence
  Description of Artificial Sequence: Synthetic oligonucleotide
gucuggagagccgguggau

SEQ ID NO: 3057 - RNA, 19 nt, Artificial Sequence
  Description of Artificial Sequence: Synthetic oligonucleotide
ugucuggagagccggugga

SEQ ID NO: 3058 - RNA, 19 nt, Artificial Sequence
  Description of Artificial Sequence: Synthetic oligonucleotide
cugucuggagagccggugg

SEQ ID NO: 3059 - RNA, 19 nt, Artificial Sequence
  Description of Artificial Sequence: Synthetic oligonucleotide
gcugucuggagagccggug

SEQ ID NO: 3060 - RNA, 19 nt, Artificial Sequence
  Description of Artificial Sequence: Synthetic oligonucleotide
ggcugucuggagagccggu

SEQ ID NO: 3061 - RNA, 19 nt, Artificial Sequence
  Description of Artificial Sequence: Synthetic oligonucleotide
uggcugucuggagagccgg

SEQ ID NO: 3062 - RNA, 19 nt, Artificial Sequence
  Description of Artificial Sequence: Synthetic oligonucleotide
uuggcugucuggagagccg

SEQ ID NO: 3063 - RNA, 19 nt, Artificial Sequence
  Description of Artificial Sequence: Synthetic oligonucleotide
guuggcugucuggagagcc

SEQ ID NO: 3064 - RNA, 19 nt, Artificial Sequence
  Description of Artificial Sequence: Synthetic oligonucleotide
gguuggcugucuggagagc

SEQ ID NO: 3065 - RNA, 19 nt, Artificial Sequence
  Description of Artificial Sequence: Synthetic oligonucleotide
ggguuggcugucuggagag

SEQ ID NO: 3066 - RNA, 19 nt, Artificial Sequence
  Description of Artificial Sequence: Synthetic oligonucleotide
cggguuggcugucuggaga

SEQ ID NO: 3067 - RNA, 19 nt, Artificial Sequence
  Description of Artificial Sequence: Synthetic oligonucleotide
ccggguuggcugucuggag

SEQ ID NO: 3068 - RNA, 19 nt, Artificial Sequence
  Description of Artificial Sequence: Synthetic oligonucleotide
gccggguuggcugucugga

SEQ ID NO: 3069 - RNA, 19 nt, Artificial Sequence
  Description of Artificial Sequence: Synthetic oligonucleotide
agccggguuggcugucugg

SEQ ID NO: 3070 - RNA, 19 nt, Artificial Sequence
  Description of Artificial Sequence: Synthetic oligonucleotide
cagccggguuggcugucug

SEQ ID NO: 3071 - RNA, 19 nt, Artificial Sequence
  Description of Artificial Sequence: Synthetic oligonucleotide
gcagccggguuggcugucu

SEQ ID NO: 3072 - RNA, 19 nt, Artificial Sequence
  Description of Artificial Sequence: Synthetic oligonucleotide
cgcagccggguuggcuguc

SEQ ID NO: 3073 - RNA, 19 nt, Artificial Sequence
  Description of Artificial Sequence: Synthetic oligonucleotide
acgcagccggguuggcugu

SEQ ID NO: 3074 - RNA, 19 nt, Artificial Sequence
  Description of Artificial Sequence: Synthetic oligonucleotide
cacgcagccggguuggcug

SEQ ID NO: 3075 - RNA, 19 nt, Artificial Sequence
  Description of Artificial Sequence: Synthetic oligonucleotide
acacgcagccggguuggcu

SEQ ID NO: 3076 - RNA, 19 nt, Artificial Sequence
  Description of Artificial Sequence: Synthetic oligonucleotide
uacacgcagccggguuggc

SEQ ID NO: 3077 - RNA, 19 nt, Artificial Sequence
  Description of Artificial Sequence: Synthetic oligonucleotide
cuacacgcagccggguugg

SEQ ID NO: 3078 - RNA, 19 nt, Artificial Sequence
  Description of Artificial Sequence: Synthetic oligonucleotide
ucuacacgcagccggguug

SEQ ID NO: 3079 - RNA, 19 nt, Artificial Sequence
  Description of Artificial Sequence: Synthetic oligonucleotide
cucuacacgcagccggguu

SEQ ID NO: 3080 - RNA, 19 nt, Artificial Sequence
  Description of Artificial Sequence: Synthetic oligonucleotide
ucucuacacgcagccgggu

SEQ ID NO: 3081 - RNA, 19 nt, Artificial Sequence
  Description of Artificial Sequence: Synthetic oligonucleotide
aucucuacacgcagccggg

SEQ ID NO: 3082 - RNA, 19 nt, Artificial Sequence
  Description of Artificial Sequence: Synthetic oligonucleotide
caucucuacacgcagccgg

SEQ ID NO: 3083 - RNA, 19 nt, Artificial Sequence
  Description of Artificial Sequence: Synthetic oligonucleotide
ccaucucuacacgcagccg

SEQ ID NO: 3084 - RNA, 19 nt, Artificial Sequence
  Description of Artificial Sequence: Synthetic oligonucleotide
uccaucucuacacgcagcc

SEQ ID NO: 3085 - RNA, 19 nt, Artificial Sequence
  Description of Artificial Sequence: Synthetic oligonucleotide
cuccaucucuacacgcagc

SEQ ID NO: 3086 - RNA, 19 nt, Artificial Sequence
  Description of Artificial Sequence: Synthetic oligonucleotide
ccuccaucucuacacgcag

SEQ ID NO: 3087 - RNA, 19 nt, Artificial Sequence
  Description of Artificial Sequence: Synthetic oligonucleotide
uccuccaucucuacacgca

SEQ ID NO: 3088 - RNA, 19 nt, Artificial Sequence
  Description of Artificial Sequence: Synthetic oligonucleotide
guccuccaucucuacacgc

SEQ ID NO: 3089 - RNA, 19 nt, Artificial Sequence
  Description of Artificial Sequence: Synthetic oligonucleotide
aguccuccaucucuacacg

SEQ ID NO: 3090 - RNA, 19 nt, Artificial Sequence
  Description of Artificial Sequence: Synthetic oligonucleotide
caguccuccaucucuacac

SEQ ID NO: 3091 - RNA, 19 nt, Artificial Sequence
  Description of Artificial Sequence: Synthetic oligonucleotide
ccaguccuccaucucuaca

SEQ ID NO: 3092 - RNA, 19 nt, Artificial Sequence
  Description of Artificial Sequence: Synthetic oligonucleotide
cccaguccuccaucucuac

SEQ ID NO: 3093 - RNA, 19 nt, Artificial Sequence
  Description of Artificial Sequence: Synthetic oligonucleotide
ucccaguccuccaucucua

SEQ ID NO: 3094 - RNA, 19 nt, Artificial Sequence
  Description of Artificial Sequence: Synthetic oligonucleotide
cucccaguccuccaucucu

SEQ ID NO: 3095 - RNA, 19 nt, Artificial Sequence
  Description of Artificial Sequence: Synthetic oligonucleotide
ccucccaguccuccaucuc

SEQ ID NO: 3096 - RNA, 19 nt, Artificial Sequence
  Description of Artificial Sequence: Synthetic oligonucleotide
cccucccaguccuccaucu

SEQ ID NO: 3097 - RNA, 19 nt, Artificial Sequence
  Description of Artificial Sequence: Synthetic oligonucleotide
gcccucccaguccuccauc

SEQ ID NO: 3098 - RNA, 19 nt, Artificial Sequence
  Description of Artificial Sequence: Synthetic oligonucleotide
ugcccucccaguccuccau

SEQ ID NO: 3099 - RNA, 19 nt, Artificial Sequence
  Description of Artificial Sequence: Synthetic oligonucleotide
uugcccucccaguccucca

SEQ ID NO: 3100 - RNA, 19 nt, Artificial Sequence
  Description of Artificial Sequence: Synthetic oligonucleotide
guugcccucccaguccucc

SEQ ID NO: 3101 - RNA, 19 nt, Artificial Sequence
  Description of Artificial Sequence: Synthetic oligonucleotide
gguugcccucccaguccuc

SEQ ID NO: 3102 - RNA, 19 nt, Artificial Sequence
  Description of Artificial Sequence: Synthetic oligonucleotide
agguugcccucccaguccu

SEQ ID NO: 3103 - RNA, 19 nt, Artificial Sequence
  Description of Artificial Sequence: Synthetic oligonucleotide
cagguugcccucccagucc

SEQ ID NO: 3104 - RNA, 19 nt, Artificial Sequence
  Description of Artificial Sequence: Synthetic oligonucleotide
gcagguugcccucccaguc

SEQ ID NO: 3105 - RNA, 19 nt, Artificial Sequence
  Description of Artificial Sequence: Synthetic oligonucleotide
cgcagguugcccucccagu

SEQ ID NO: 3106 - RNA, 19 nt, Artificial Sequence
  Description of Artificial Sequence: Synthetic oligonucleotide
gcgcagguugcccucccag

SEQ ID NO: 3107 - RNA, 19 nt, Artificial Sequence
  Description of Artificial Sequence: Synthetic oligonucleotide
agcgcagguugcccuccca

SEQ ID NO: 3108 - RNA, 19 nt, Artificial Sequence
  Description of Artificial Sequence: Synthetic oligonucleotide
uagcgcagguugcccuccc

SEQ ID NO: 3109 - RNA, 19 nt, Artificial Sequence
  Description of Artificial Sequence: Synthetic oligonucleotide
guagcgcagguugcccucc

SEQ ID NO: 3110 - RNA, 19 nt, Artificial Sequence
  Description of Artificial Sequence: Synthetic oligonucleotide
cguagcgcagguugcccuc

SEQ ID NO: 3111 - RNA, 19 nt, Artificial Sequence
  Description of Artificial Sequence: Synthetic oligonucleotide
gcguagcgcagguugcccu

SEQ ID NO: 3112 - RNA, 19 nt, Artificial Sequence
  Description of Artificial Sequence: Synthetic oligonucleotide
agcguagcgcagguugccc

SEQ ID NO: 3113 - RNA, 19 nt, Artificial Sequence
  Description of Artificial Sequence: Synthetic oligonucleotide
cagcguagcgcagguugcc

SEQ ID NO: 3114 - RNA, 19 nt, Artificial Sequence
  Description of Artificial Sequence: Synthetic oligonucleotide
ucagcguagcgcagguugc

SEQ ID NO: 3115 - RNA, 19 nt, Artificial Sequence
  Description of Artificial Sequence: Synthetic oligonucleotide
cucagcguagcgcagguug

SEQ ID NO: 3116 - RNA, 19 nt, Artificial Sequence
  Description of Artificial Sequence: Synthetic oligonucleotide
acucagcguagcgcagguu

SEQ ID NO: 3117 - RNA, 19 nt, Artificial Sequence
  Description of Artificial Sequence: Synthetic oligonucleotide
uacucagcguagcgcaggu

SEQ ID NO: 3118 - RNA, 19 nt, Artificial Sequence
  Description of Artificial Sequence: Synthetic oligonucleotide
auacucagcguagcgcagg

SEQ ID NO: 3119 - RNA, 19 nt, Artificial Sequence
  Description of Artificial Sequence: Synthetic oligonucleotide
uauacucagcguagcgcag

SEQ ID NO: 3120 - RNA, 19 nt, Artificial Sequence
  Description of Artificial Sequence: Synthetic oligonucleotide
cuauacucagcguagcgca

SEQ ID NO: 3121 - RNA, 19 nt, Artificial Sequence
  Description of Artificial Sequence: Synthetic oligonucleotide
gcuauacucagcguagcgc

SEQ ID NO: 3122 - RNA, 19 nt, Artificial Sequence
  Description of Artificial Sequence: Synthetic oligonucleotide
ggcuauacucagcguagcg

SEQ ID NO: 3123 - RNA, 19 nt, Artificial Sequence
  Description of Artificial Sequence: Synthetic oligonucleotide
uggcuauacucagcguagc

SEQ ID NO: 3124 - RNA, 19 nt, Artificial Sequence
  Description of Artificial Sequence: Synthetic oligonucleotide
guggcuauacucagcguag

SEQ ID NO: 3125 - RNA, 19 nt, Artificial Sequence
  Description of Artificial Sequence: Synthetic oligonucleotide
aguggcuauacucagcgua

SEQ ID NO: 3126 - RNA, 19 nt, Artificial Sequence
  Description of Artificial Sequence: Synthetic oligonucleotide
aaguggcuauacucagcgu

SEQ ID NO: 3127 - RNA, 19 nt, Artificial Sequence
  Description of Artificial Sequence: Synthetic oligonucleotide
aaaguggcuauacucagcg

SEQ ID NO: 3128 - RNA, 19 nt, Artificial Sequence
  Description of Artificial Sequence: Synthetic oligonucleotide
caaaguggcuauacucagc

SEQ ID NO: 3129 - RNA, 19 nt, Artificial Sequence
  Description of Artificial Sequence: Synthetic oligonucleotide
acaaaguggcuauacucag

SEQ ID NO: 3130 - RNA, 19 nt, Artificial Sequence
  Description of Artificial Sequence: Synthetic oligonucleotide
aacaaaguggcuauacuca

SEQ ID NO: 3131 - RNA, 19 nt, Artificial Sequence
  Description of Artificial Sequence: Synthetic oligonucleotide
aaacaaaguggcuauacuc

SEQ ID NO: 3132 - RNA, 19 nt, Artificial Sequence
  Description of Artificial Sequence: Synthetic oligonucleotide
aaaacaaaguggcuauacu

SEQ ID NO: 3133 - RNA, 19 nt, Artificial Sequence
  Description of Artificial Sequence: Synthetic oligonucleotide
caaaacaaaguggcuauac

SEQ ID NO: 3134 - RNA, 19 nt, Artificial Sequence
  Description of Artificial Sequence: Synthetic oligonucleotide
ccaaaacaaaguggcuaua

SEQ ID NO: 3135 - RNA, 19 nt, Artificial Sequence
  Description of Artificial Sequence: Synthetic oligonucleotide
cccaaaacaaaguggcuau

SEQ ID NO: 3136 - RNA, 19 nt, Artificial Sequence
  Description of Artificial Sequence: Synthetic oligonucleotide
gcccaaaacaaaguggcua

SEQ ID NO: 3137 - RNA, 19 nt, Artificial Sequence
  Description of Artificial Sequence: Synthetic oligonucleotide
ugcccaaaacaaaguggcu

SEQ ID NO: 3138 - RNA, 19 nt, Artificial Sequence
  Description of Artificial Sequence: Synthetic oligonucleotide
uugcccaaaacaaaguggc

SEQ ID NO: 3139 - RNA, 19 nt, Artificial Sequence
  Description of Artificial Sequence: Synthetic oligonucleotide
auugcccaaaacaaagugg

SEQ ID NO: 3140 - RNA, 19 nt, Artificial Sequence
  Description of Artificial Sequence: Synthetic oligonucleotide
cauugcccaaaacaaagug

SEQ ID NO: 3141 - RNA, 19 nt, Artificial Sequence
  Description of Artificial Sequence: Synthetic oligonucleotide
ucauugcccaaaacaaagu

SEQ ID NO: 3142 - RNA, 19 nt, Artificial Sequence
  Description of Artificial Sequence: Synthetic oligonucleotide
uucauugcccaaaacaaag

SEQ ID NO: 3143 - RNA, 19 nt, Artificial Sequence
  Description of Artificial Sequence: Synthetic oligonucleotide
guucauugcccaaaacaaa

SEQ ID NO: 3144 - RNA, 19 nt, Artificial Sequence
  Description of Artificial Sequence: Synthetic oligonucleotide
aguucauugcccaaaacaa

SEQ ID NO: 3145 - RNA, 19 nt, Artificial Sequence
  Description of Artificial Sequence: Synthetic oligonucleotide
gaguucauugcccaaaaca

SEQ ID NO: 3146 - RNA, 19 nt, Artificial Sequence
  Description of Artificial Sequence: Synthetic oligonucleotide
ugaguucauugcccaaaac

SEQ ID NO: 3147 - RNA, 19 nt, Artificial Sequence
  Description of Artificial Sequence: Synthetic oligonucleotide
uugaguucauugcccaaaa

SEQ ID NO: 3148 - RNA, 19 nt, Artificial Sequence
  Description of Artificial Sequence: Synthetic oligonucleotide
guugaguucauugcccaaa

SEQ ID NO: 3149 - RNA, 19 nt, Artificial Sequence
  Description of Artificial Sequence: Synthetic oligonucleotide
uguugaguucauugcccaa

SEQ ID NO: 3150 - RNA, 19 nt, Artificial Sequence
  Description of Artificial Sequence: Synthetic oligonucleotide
cuguugaguucauugccca

SEQ ID NO: 3151 - RNA, 19 nt, Artificial Sequence
  Description of Artificial Sequence: Synthetic oligonucleotide
gcuguugaguucauugccc

SEQ ID NO: 3152 - RNA, 19 nt, Artificial Sequence
  Description of Artificial Sequence: Synthetic oligonucleotide
agcuguugaguucauugcc

SEQ ID NO: 3153 - RNA, 19 nt, Artificial Sequence
  Description of Artificial Sequence: Synthetic oligonucleotide
uagcuguugaguucauugc

SEQ ID NO: 3154 - RNA, 19 nt, Artificial Sequence
  Description of Artificial Sequence: Synthetic oligonucleotide
auagcuguugaguucauug

SEQ ID NO: 3155 - RNA, 19 nt, Artificial Sequence
  Description of Artificial Sequence: Synthetic oligonucleotide
gauagcuguugaguucauu

SEQ ID NO: 3156 - RNA, 19 nt, Artificial Sequence
  Description of Artificial Sequence: Synthetic oligonucleotide
cgauagcuguugaguucau

SEQ ID NO: 3157 - RNA, 19 nt, Artificial Sequence
  Description of Artificial Sequence: Synthetic oligonucleotide
gcgauagcuguugaguuca

SEQ ID NO: 3158 - RNA, 19 nt, Artificial Sequence
  Description of Artificial Sequence: Synthetic oligonucleotide
ggcgauagcuguugaguuc

SEQ ID NO: 3159 - RNA, 19 nt, Artificial Sequence
  Description of Artificial Sequence: Synthetic oligonucleotide
aggcgauagcuguugaguu

SEQ ID NO: 3160 - RNA, 19 nt, Artificial Sequence
  Description of Artificial Sequence: Synthetic oligonucleotide
gaggcgauagcuguugagu

SEQ ID NO: 3161 - RNA, 19 nt, Artificial Sequence
  Description of Artificial Sequence: Synthetic oligonucleotide
agaggcgauagcuguugag

SEQ ID NO: 3162 - RNA, 19 nt, Artificial Sequence
  Description of Artificial Sequence: Synthetic oligonucleotide
aagaggcgauagcuguuga

SEQ ID NO: 3163 - RNA, 19 nt, Artificial Sequence
  Description of Artificial Sequence: Synthetic oligonucleotide
gaagaggcgauagcuguug

SEQ ID NO: 3164 - RNA, 19 nt, Artificial Sequence
  Description of Artificial Sequence: Synthetic oligonucleotide
ggaagaggcgauagcuguu

SEQ ID NO: 3165 - RNA, 19 nt, Artificial Sequence
  Description of Artificial Sequence: Synthetic oligonucleotide
aggaagaggcgauagcugu

SEQ ID NO: 3166 - RNA, 19 nt, Artificial Sequence
  Description of Artificial Sequence: Synthetic oligonucleotide
caggaagaggcgauagcug

SEQ ID NO: 3167 - RNA, 19 nt, Artificial Sequence
  Description of Artificial Sequence: Synthetic oligonucleotide
ccaggaagaggcgauagcu

SEQ ID NO: 3168 - RNA, 19 nt, Artificial Sequence
  Description of Artificial Sequence: Synthetic oligonucleotide
cccaggaagaggcgauagc

SEQ ID NO: 3169 - RNA, 19 nt, Artificial Sequence
  Description of Artificial Sequence: Synthetic oligonucleotide
ccccaggaagaggcgauag

SEQ ID NO: 3170 - RNA, 19 nt, Artificial Sequence
  Description of Artificial Sequence: Synthetic oligonucleotide
uccccaggaagaggcgaua

SEQ ID NO: 3171 - RNA, 19 nt, Artificial Sequence
  Description of Artificial Sequence: Synthetic oligonucleotide
uuccccaggaagaggcgau

SEQ ID NO: 3172 - RNA, 19 nt, Artificial Sequence
  Description of Artificial Sequence: Synthetic oligonucleotide
guuccccaggaagaggcga

SEQ ID NO: 3173 - RNA, 19 nt, Artificial Sequence
  Description of Artificial Sequence: Synthetic oligonucleotide
aguuccccaggaagaggcg

SEQ ID NO: 3174 - RNA, 19 nt, Artificial Sequence
  Description of Artificial Sequence: Synthetic oligonucleotide
uaguuccccaggaagaggc

SEQ ID NO: 3175 - RNA, 19 nt, Artificial Sequence
  Description of Artificial Sequence: Synthetic oligonucleotide
guaguuccccaggaagagg

SEQ ID NO: 3176 - RNA, 19 nt, Artificial Sequence
  Description of Artificial Sequence: Synthetic oligonucleotide
uguaguuccccaggaagag

SEQ ID NO: 3177 - RNA, 19 nt, Artificial Sequence
  Description of Artificial Sequence: Synthetic oligonucleotide
guguaguuccccaggaaga

SEQ ID NO: 3178 - RNA, 19 nt, Artificial Sequence
  Description of Artificial Sequence: Synthetic oligonucleotide
aguguaguuccccaggaag

SEQ ID NO: 3179 - RNA, 19 nt, Artificial Sequence
  Description of Artificial Sequence: Synthetic oligonucleotide
caguguaguuccccaggaa

SEQ ID NO: 3180 - RNA, 19 nt, Artificial Sequence
  Description of Artificial Sequence: Synthetic oligonucleotide
ccaguguaguuccccagga

SEQ ID NO: 3181 - RNA, 19 nt, Artificial Sequence
  Description of Artificial Sequence: Synthetic oligonucleotide
gccaguguaguuccccagg

SEQ ID NO: 3182 - RNA, 19 nt, Artificial Sequence
  Description of Artificial Sequence: Synthetic oligonucleotide
ugccaguguaguuccccag

SEQ ID NO: 3183 - RNA, 19 nt, Artificial Sequence
  Description of Artificial Sequence: Synthetic oligonucleotide
uugccaguguaguucccca

SEQ ID NO: 3184 - RNA, 19 nt, Artificial Sequence
  Description of Artificial Sequence: Synthetic oligonucleotide
auugccaguguaguucccc

SEQ ID NO: 3185 - RNA, 19 nt, Artificial Sequence
  Description of Artificial Sequence: Synthetic oligonucleotide
cauugccaguguaguuccc

SEQ ID NO: 3186 - RNA, 19 nt, Artificial Sequence
  Description of Artificial Sequence: Synthetic oligonucleotide
acauugccaguguaguucc

SEQ ID NO: 3187 - RNA, 19 nt, Artificial Sequence
  Description of Artificial Sequence: Synthetic oligonucleotide
cacauugccaguguaguuc

SEQ ID NO: 3188 - RNA, 19 nt, Artificial Sequence
  Description of Artificial Sequence: Synthetic oligonucleotide
ccacauugccaguguaguu

SEQ ID NO: 3189 - RNA, 19 nt, Artificial Sequence
  Description of Artificial Sequence: Synthetic oligonucleotide
cccacauugccaguguagu

SEQ ID NO: 3190 - RNA, 19 nt, Artificial Sequence
  Description of Artificial Sequence: Synthetic oligonucleotide
ccccacauugccaguguag

SEQ ID NO: 3191 - RNA, 19 nt, Artificial Sequence
  Description of Artificial Sequence: Synthetic oligonucleotide
uccccacauugccagugua

SEQ ID NO: 3192 - RNA, 19 nt, Artificial Sequence
  Description of Artificial Sequence: Synthetic oligonucleotide
uuccccacauugccagugu

SEQ ID NO: 3193 - RNA, 19 nt, Artificial Sequence
  Description of Artificial Sequence: Synthetic oligonucleotide
guuccccacauugccagug

SEQ ID NO: 3194 - RNA, 19 nt, Artificial Sequence
  Description of Artificial Sequence: Synthetic oligonucleotide
cguuccccacauugccagu

SEQ ID NO: 3195 - RNA, 19 nt, Artificial Sequence
  Description of Artificial Sequence: Synthetic oligonucleotide
ucguuccccacauugccag

SEQ ID NO: 3196 - RNA, 19 nt, Artificial Sequence
  Description of Artificial Sequence: Synthetic oligonucleotide
gucguuccccacauugcca

SEQ ID NO: 3197 - RNA, 19 nt, Artificial Sequence
  Description of Artificial Sequence: Synthetic oligonucleotide
cgucguuccccacauugcc

SEQ ID NO: 3198 - RNA, 19 nt, Artificial Sequence
  Description of Artificial Sequence: Synthetic oligonucleotide
gcgucguuccccacauugc

SEQ ID NO: 3199 - RNA, 19 nt, Artificial Sequence
  Description of Artificial Sequence: Synthetic oligonucleotide
ggcgucguuccccacauug

SEQ ID NO: 3200 - RNA, 19 nt, Artificial Sequence
  Description of Artificial Sequence: Synthetic oligonucleotide
gggcgucguuccccacauu

SEQ ID NO: 3201 - RNA, 19 nt, Artificial Sequence
  Description of Artificial Sequence: Synthetic oligonucleotide
agggcgucguuccccacau

SEQ ID NO: 3202 - RNA, 19 nt, Artificial Sequence
  Description of Artificial Sequence: Synthetic oligonucleotide
gagggcgucguuccccaca

SEQ ID NO: 3203 - RNA, 19 nt, Artificial Sequence
  Description of Artificial Sequence: Synthetic oligonucleotide
ggagggcgucguuccccac

SEQ ID NO: 3204 - RNA, 19 nt, Artificial Sequence
  Description of Artificial Sequence: Synthetic oligonucleotide
uggagggcgucguucccca

SEQ ID NO: 3205 - RNA, 19 nt, Artificial Sequence
  Description of Artificial Sequence: Synthetic oligonucleotide
cuggagggcgucguucccc

SEQ ID NO: 3206 - RNA, 19 nt, Artificial Sequence
  Description of Artificial Sequence: Synthetic oligonucleotide
acuggagggcgucguuccc

SEQ ID NO: 3207 - RNA, 19 nt, Artificial Sequence
  Description of Artificial Sequence: Synthetic oligonucleotide
uacuggagggcgucguucc

SEQ ID NO: 3208 - RNA, 19 nt, Artificial Sequence
  Description of Artificial Sequence: Synthetic oligonucleotide
auacuggagggcgucguuc

SEQ ID NO: 3209 - RNA, 19 nt, Artificial Sequence
  Description of Artificial Sequence: Synthetic oligonucleotide
gauacuggagggcgucguu

SEQ ID NO: 3210 - RNA, 19 nt, Artificial Sequence
  Description of Artificial Sequence: Synthetic oligonucleotide
ugauacuggagggcgucgu

SEQ ID NO: 3211 - RNA, 19 nt, Artificial Sequence
  Description of Artificial Sequence: Synthetic oligonucleotide
augauacuggagggcgucg

SEQ ID NO: 3212 - RNA, 19 nt, Artificial Sequence
  Description of Artificial Sequence: Synthetic oligonucleotide
uaugauacuggagggcguc

SEQ ID NO: 3213 - RNA, 19 nt, Artificial Sequence
  Description of Artificial Sequence: Synthetic oligonucleotide
uuaugauacuggagggcgu

SEQ ID NO: 3214 - RNA, 19 nt, Artificial Sequence
  Description of Artificial Sequence: Synthetic oligonucleotide
guuaugauacuggagggcg

SEQ ID NO: 3215 - RNA, 19 nt, Artificial Sequence
  Description of Artificial Sequence: Synthetic oligonucleotide
uguuaugauacuggagggc

SEQ ID NO: 3216 - RNA, 19 nt, Artificial Sequence
  Description of Artificial Sequence: Synthetic oligonucleotide
uuguuaugauacuggaggg

SEQ ID NO: 3217 - RNA, 19 nt, Artificial Sequence
  Description of Artificial Sequence: Synthetic oligonucleotide
guuguuaugauacuggagg

SEQ ID NO: 3218 - RNA, 19 nt, Artificial Sequence
  Description of Artificial Sequence: Synthetic oligonucleotide
uguuguuaugauacuggag

SEQ ID NO: 3219 - RNA, 19 nt, Artificial Sequence
  Description of Artificial Sequence: Synthetic oligonucleotide
guguuguuaugauacugga

SEQ ID NO: 3220 - RNA, 19 nt, Artificial Sequence
  Description of Artificial Sequence: Synthetic oligonucleotide
uguguuguuaugauacugg

SEQ ID NO: 3221 - RNA, 19 nt, Artificial Sequence
  Description of Artificial Sequence: Synthetic oligonucleotide
cuguguuguuaugauacug

SEQ ID NO: 3222 - RNA, 19 nt, Artificial Sequence
  Description of Artificial Sequence: Synthetic oligonucleotide
gcuguguuguuaugauacu

SEQ ID NO: 3223 - RNA, 19 nt, Artificial Sequence
  Description of Artificial Sequence: Synthetic oligonucleotide
ggcuguguuguuaugauac

SEQ ID NO: 3224 - RNA, 19 nt, Artificial Sequence
  Description of Artificial Sequence: Synthetic oligonucleotide
aggcuguguuguuaugaua

SEQ ID NO: 3225 - RNA, 19 nt, Artificial Sequence
  Description of Artificial Sequence: Synthetic oligonucleotide
aaggcuguguuguuaugau

SEQ ID NO: 3226 - RNA, 19 nt, Artificial Sequence
  Description of Artificial Sequence: Synthetic oligonucleotide
gaaggcuguguuguuauga

SEQ ID NO: 3227 - RNA, 19 nt, Artificial Sequence
  Description of Artificial Sequence: Synthetic oligonucleotide
ugaaggcuguguuguuaug

SEQ ID NO: 3228 - RNA, 19 nt, Artificial Sequence
  Description of Artificial Sequence: Synthetic oligonucleotide
cugaaggcuguguuguuau

SEQ ID NO: 3229 - RNA, 19 nt, Artificial Sequence
  Description of Artificial Sequence: Synthetic oligonucleotide
gcugaaggcuguguuguua

SEQ ID NO: 3230 - RNA, 19 nt, Artificial Sequence
  Description of Artificial Sequence: Synthetic oligonucleotide
ugcugaaggcuguguuguu

SEQ ID NO: 3231 - RNA, 19 nt, Artificial Sequence
  Description of Artificial Sequence: Synthetic oligonucleotide
gugcugaaggcuguguugu

SEQ ID NO: 3232 - RNA, 19 nt, Artificial Sequence
  Description of Artificial Sequence: Synthetic oligonucleotide
ggugcugaaggcuguguug

SEQ ID NO: 3233 - RNA, 19 nt, Artificial Sequence
  Description of Artificial Sequence: Synthetic oligonucleotide
uggugcugaaggcuguguu

SEQ ID NO: 3234 - RNA, 19 nt, Artificial Sequence
  Description of Artificial Sequence: Synthetic oligonucleotide
uuggugcugaaggcugugu

SEQ ID NO: 3235 - RNA, 19 nt, Artificial Sequence
  Description of Artificial Sequence: Synthetic oligonucleotide
cuuggugcugaaggcugug

SEQ ID NO: 3236 - RNA, 19 nt, Artificial Sequence
  Description of Artificial Sequence: Synthetic oligonucleotide
ccuuggugcugaaggcugu

SEQ ID NO: 3237 - RNA, 19 nt, Artificial Sequence
  Description of Artificial Sequence: Synthetic oligonucleotide
uccuuggugcugaaggcug

SEQ ID NO: 3238 - RNA, 19 nt, Artificial Sequence
  Description of Artificial Sequence: Synthetic oligonucleotide
guccuuggugcugaaggcu

SEQ ID NO: 3239 - RNA, 19 nt, Artificial Sequence
  Description of Artificial Sequence: Synthetic oligonucleotide
uguccuuggugcugaaggc

SEQ ID NO: 3240 - RNA, 19 nt, Artificial Sequence
  Description of Artificial Sequence: Synthetic oligonucleotide
uuguccuuggugcugaagg

SEQ ID NO: 3241 - RNA, 19 nt, Artificial Sequence
  Description of Artificial Sequence: Synthetic oligonucleotide
cuuguccuuggugcugaag

SEQ ID NO: 3242 - RNA, 19 nt, Artificial Sequence
  Description of Artificial Sequence: Synthetic oligonucleotide
ccuuguccuuggugcugaa

SEQ ID NO: 3243 - RNA, 19 nt, Artificial Sequence
  Description of Artificial Sequence: Synthetic oligonucleotide
uccuuguccuuggugcuga

SEQ ID NO: 3244 - RNA, 19 nt, Artificial Sequence
  Description of Artificial Sequence: Synthetic oligonucleotide
guccuuguccuuggugcug

SEQ ID NO: 3245 - RNA, 19 nt, Artificial Sequence
  Description of Artificial Sequence: Synthetic oligonucleotide
uguccuuguccuuggugcu

SEQ ID NO: 3246 - RNA, 19 nt, Artificial Sequence
  Description of Artificial Sequence: Synthetic oligonucleotide
uuguccuuguccuuggugc

SEQ ID NO: 3247 - RNA, 19 nt, Artificial Sequence
  Description of Artificial Sequence: Synthetic oligonucleotide
auuguccuuguccuuggug

SEQ ID NO: 3248 - RNA, 19 nt, Artificial Sequence
  Description of Artificial Sequence: Synthetic oligonucleotide
cauuguccuuguccuuggu

SEQ ID NO: 3249 - RNA, 19 nt, Artificial Sequence
  Description of Artificial Sequence: Synthetic oligonucleotide
ucauuguccuuguccuugg

SEQ ID NO: 3250 - RNA, 19 nt, Artificial Sequence
  Description of Artificial Sequence: Synthetic oligonucleotide
gucauuguccuuguccuug

SEQ ID NO: 3251 - RNA, 19 nt, Artificial Sequence
  Description of Artificial Sequence: Synthetic oligonucleotide
ugucauuguccuuguccuu

SEQ ID NO: 3252 - RNA, 19 nt, Artificial Sequence
  Description of Artificial Sequence: Synthetic oligonucleotide
uugucauuguccuuguccu

SEQ ID NO: 3253 - RNA, 19 nt, Artificial Sequence
  Description of Artificial Sequence: Synthetic oligonucleotide
guugucauuguccuugucc

SEQ ID NO: 3254 - RNA, 19 nt, Artificial Sequence
  Description of Artificial Sequence: Synthetic oligonucleotide
aguugucauuguccuuguc

SEQ ID NO: 3255 - RNA, 19 nt, Artificial Sequence
  Description of Artificial Sequence: Synthetic oligonucleotide
caguugucauuguccuugu

SEQ ID NO: 3256 - RNA, 19 nt, Artificial Sequence
  Description of Artificial Sequence: Synthetic oligonucleotide
gcaguugucauuguccuug

SEQ ID NO: 3257 - RNA, 19 nt, Artificial Sequence
  Description of Artificial Sequence: Synthetic oligonucleotide
agcaguugucauuguccuu

SEQ ID NO: 3258 - RNA, 19 nt, Artificial Sequence
  Description of Artificial Sequence: Synthetic oligonucleotide
aagcaguugucauuguccu

SEQ ID NO: 3259 - RNA, 19 nt, Artificial Sequence
  Description of Artificial Sequence: Synthetic oligonucleotide
caagcaguugucauugucc

SEQ ID NO: 3260 - RNA, 19 nt, Artificial Sequence
  Description of Artificial Sequence: Synthetic oligonucleotide
ccaagcaguugucauuguc

SEQ ID NO: 3261 - RNA, 19 nt, Artificial Sequence
  Description of Artificial Sequence: Synthetic oligonucleotide
uccaagcaguugucauugu

SEQ ID NO: 3262 - RNA, 19 nt, Artificial Sequence
  Description of Artificial Sequence: Synthetic oligonucleotide
guccaagcaguugucauug

SEQ ID NO: 3263 - RNA, 19 nt, Artificial Sequence
  Description of Artificial Sequence: Synthetic oligonucleotide
uguccaagcaguugucauu

SEQ ID NO: 3264 - RNA, 19 nt, Artificial Sequence
  Description of Artificial Sequence: Synthetic oligonucleotide
uuguccaagcaguugucau

SEQ ID NO: 3265 - RNA, 19 nt, Artificial Sequence
  Description of Artificial Sequence: Synthetic oligonucleotide
cuuguccaagcaguuguca

SEQ ID NO: 3266 - RNA, 19 nt, Artificial Sequence
  Description of Artificial Sequence: Synthetic oligonucleotide
acuuguccaagcaguuguc

SEQ ID NO: 3267 - RNA, 19 nt, Artificial Sequence
  Description of Artificial Sequence: Synthetic oligonucleotide
cacuuguccaagcaguugu

SEQ ID NO: 3268 - RNA, 19 nt, Artificial Sequence
  Description of Artificial Sequence: Synthetic oligonucleotide
acacuuguccaagcaguug

SEQ ID NO: 3269 - RNA, 19 nt, Artificial Sequence
  Description of Artificial Sequence: Synthetic oligonucleotide
cacacuuguccaagcaguu

SEQ ID NO: 3270 - RNA, 19 nt, Artificial Sequence
  Description of Artificial Sequence: Synthetic oligonucleotide
gcacacuuguccaagcagu

SEQ ID NO: 3271 - RNA, 19 nt, Artificial Sequence
  Description of Artificial Sequence: Synthetic oligonucleotide
ugcacacuuguccaagcag

SEQ ID NO: 3272 - RNA, 19 nt, Artificial Sequence
  Description of Artificial Sequence: Synthetic oligonucleotide
gugcacacuuguccaagca

SEQ ID NO: 3273 - RNA, 19 nt, Artificial Sequence
  Description of Artificial Sequence: Synthetic oligonucleotide
ugugcacacuuguccaagc

SEQ ID NO: 3274 - RNA, 19 nt, Artificial Sequence
  Description of Artificial Sequence: Synthetic oligonucleotide
cugugcacacuuguccaag

SEQ ID NO: 3275 - RNA, 19 nt, Artificial Sequence
  Description of Artificial Sequence: Synthetic oligonucleotide
gcugugcacacuuguccaa

SEQ ID NO: 3276 - RNA, 19 nt, Artificial Sequence
  Description of Artificial Sequence: Synthetic oligonucleotide
agcugugcacacuugucca

SEQ ID NO: 3277 - RNA, 19 nt, Artificial Sequence
  Description of Artificial Sequence: Synthetic oligonucleotide
gagcugugcacacuugucc

SEQ ID NO: 3278 - RNA, 19 nt, Artificial Sequence
  Description of Artificial Sequence: Synthetic oligonucleotide
ggagcugugcacacuuguc

SEQ ID NO: 3279 - RNA, 19 nt, Artificial Sequence
  Description of Artificial Sequence: Synthetic oligonucleotide
cggagcugugcacacuugu

SEQ ID NO: 3280 - RNA, 19 nt, Artificial Sequence
  Description of Artificial Sequence: Synthetic oligonucleotide
gcggagcugugcacacuug

SEQ ID NO: 3281 - RNA, 19 nt, Artificial Sequence
  Description of Artificial Sequence: Synthetic oligonucleotide
ugcggagcugugcacacuu

SEQ ID NO: 3282 - RNA, 19 nt, Artificial Sequence
  Description of Artificial Sequence: Synthetic oligonucleotide
uugcggagcugugcacacu

SEQ ID NO: 3283 - RNA, 19 nt, Artificial Sequence
  Description of Artificial Sequence: Synthetic oligonucleotide
uuugcggagcugugcacac

SEQ ID NO: 3284 - RNA, 19 nt, Artificial Sequence
  Description of Artificial Sequence: Synthetic oligonucleotide
cuuugcggagcugugcaca

SEQ ID NO: 3285 - RNA, 19 nt, Artificial Sequence
  Description of Artificial Sequence: Synthetic oligonucleotide
ccuuugcggagcugugcac

SEQ ID NO: 3286 - RNA, 19 nt, Artificial Sequence
  Description of Artificial Sequence: Synthetic oligonucleotide
accuuugcggagcugugca

SEQ ID NO: 3287 - RNA, 19 nt, Artificial Sequence
  Description of Artificial Sequence: Synthetic oligonucleotide
caccuuugcggagcugugc

SEQ ID NO: 3288 - RNA, 19 nt, Artificial Sequence
  Description of Artificial Sequence: Synthetic oligonucleotide
ccaccuuugcggagcugug

SEQ ID NO: 3289 - RNA, 19 nt, Artificial Sequence
  Description of Artificial Sequence: Synthetic oligonucleotide
gccaccuuugcggagcugu

SEQ ID NO: 3290 - RNA, 19 nt, Artificial Sequence
  Description of Artificial Sequence: Synthetic oligonucleotide
agccaccuuugcggagcug

SEQ ID NO: 3291 - RNA, 19 nt, Artificial Sequence
  Description of Artificial Sequence: Synthetic oligonucleotide
uagccaccuuugcggagcu

SEQ ID NO: 3292 - RNA, 19 nt, Artificial Sequence
  Description of Artificial Sequence: Synthetic oligonucleotide
guagccaccuuugcggagc

SEQ ID NO: 3293 - RNA, 19 nt, Artificial Sequence
  Description of Artificial Sequence: Synthetic oligonucleotide
aguagccaccuuugcggag

SEQ ID NO: 3294 - RNA, 19 nt, Artificial Sequence
  Description of Artificial Sequence: Synthetic oligonucleotide
caguagccaccuuugcgga

SEQ ID NO: 3295 - RNA, 19 nt, Artificial Sequence
  Description of Artificial Sequence: Synthetic oligonucleotide
ccaguagccaccuuugcgg

SEQ ID NO: 3296 - RNA, 19 nt, Artificial Sequence
  Description of Artificial Sequence: Synthetic oligonucleotide
accaguagccaccuuugcg

SEQ ID NO: 3297 - RNA, 19 nt, Artificial Sequence
  Description of Artificial Sequence: Synthetic oligonucleotide
uaccaguagccaccuuugc

SEQ ID NO: 3298 - RNA, 19 nt, Artificial Sequence
  Description of Artificial Sequence: Synthetic oligonucleotide
guaccaguagccaccuuug

SEQ ID NO: 3299 - RNA, 19 nt, Artificial Sequence
  Description of Artificial Sequence: Synthetic oligonucleotide
uguaccaguagccaccuuu

SEQ ID NO: 3300 - RNA, 19 nt, Artificial Sequence
  Description of Artificial Sequence: Synthetic oligonucleotide
uuguaccaguagccaccuu

SEQ ID NO: 3301 - RNA, 19 nt, Artificial Sequence
  Description of Artificial Sequence: Synthetic oligonucleotide
guuguaccaguagccaccu

SEQ ID NO: 3302 - RNA, 19 nt, Artificial Sequence
  Description of Artificial Sequence: Synthetic oligonucleotide
aguuguaccaguagccacc

SEQ ID NO: 3303 - RNA, 19 nt, Artificial Sequence
  Description of Artificial Sequence: Synthetic oligonucleotide
caguuguaccaguagccac

SEQ ID NO: 3304 - RNA, 19 nt, Artificial Sequence
  Description of Artificial Sequence: Synthetic oligonucleotide
gcaguuguaccaguagcca

SEQ ID NO: 3305 - RNA, 19 nt, Artificial Sequence
  Description of Artificial Sequence: Synthetic oligonucleotide
agcaguuguaccaguagcc

SEQ ID NO: 3306 - RNA, 19 nt, Artificial Sequence
  Description of Artificial Sequence: Synthetic oligonucleotide
cagcaguuguaccaguagc

SEQ ID NO: 3307 - RNA, 19 nt, Artificial Sequence
  Description of Artificial Sequence: Synthetic oligonucleotide
gcagcaguuguaccaguag

SEQ ID NO: 3308 - RNA, 19 nt, Artificial Sequence
  Description of Artificial Sequence: Synthetic oligonucleotide
ugcagcaguuguaccagua

SEQ ID NO: 3309 - RNA, 19 nt, Artificial Sequence
  Description of Artificial Sequence: Synthetic oligonucleotide
gugcagcaguuguaccagu

SEQ ID NO: 3310 - RNA, 19 nt, Artificial Sequence
  Description of Artificial Sequence: Synthetic oligonucleotide
ugugcagcaguuguaccag

SEQ ID NO: 3311 - RNA, 19 nt, Artificial Sequence
  Description of Artificial Sequence: Synthetic oligonucleotide
cugugcagcaguuguacca

SEQ ID NO: 3312 - RNA, 19 nt, Artificial Sequence
  Description of Artificial Sequence: Synthetic oligonucleotide
ucugugcagcaguuguacc

SEQ ID NO: 3313 - RNA, 19 nt, Artificial Sequence
  Description of Artificial Sequence: Synthetic oligonucleotide
gucugugcagcaguuguac

SEQ ID NO: 3314 - RNA, 19 nt, Artificial Sequence
  Description of Artificial Sequence: Synthetic oligonucleotide
agucugugcagcaguugua

SEQ ID NO: 3315 - RNA, 19 nt, Artificial Sequence
  Description of Artificial Sequence: Synthetic oligonucleotide
gagucugugcagcaguugu

SEQ ID NO: 3316 - RNA, 19 nt, Artificial Sequence
  Description of Artificial Sequence: Synthetic oligonucleotide
ggagucugugcagcaguug

SEQ ID NO: 3317 - RNA, 19 nt, Artificial Sequence
  Description of Artificial Sequence: Synthetic oligonucleotide
uggagucugugcagcaguu

SEQ ID NO: 3318 - RNA, 19 nt, Artificial Sequence
  Description of Artificial Sequence: Synthetic oligonucleotide
uuggagucugugcagcagu

SEQ ID NO: 3319 - RNA, 19 nt, Artificial Sequence
  Description of Artificial Sequence: Synthetic oligonucleotide
guuggagucugugcagcag

SEQ ID NO: 3320 - RNA, 19 nt, Artificial Sequence
  Description of Artificial Sequence: Synthetic oligonucleotide
gguuggagucugugcagca

SEQ ID NO: 3321 - RNA, 19 nt, Artificial Sequence
  Description of Artificial Sequence: Synthetic oligonucleotide
agguuggagucugugcagc

SEQ ID NO: 3322 - RNA, 19 nt, Artificial Sequence
  Description of Artificial Sequence: Synthetic oligonucleotide
gagguuggagucugugcag

SEQ ID NO: 3323 - RNA, 19 nt, Artificial Sequence
  Description of Artificial Sequence: Synthetic oligonucleotide
ugagguuggagucugugca

SEQ ID NO: 3324 - RNA, 19 nt, Artificial Sequence
  Description of Artificial Sequence: Synthetic oligonucleotide
uugagguuggagucugugc

SEQ ID NO: 3325 - RNA, 19 nt, Artificial Sequence
  Description of Artificial Sequence: Synthetic oligonucleotide
auugagguuggagucugug

SEQ ID NO: 3326 - RNA, 19 nt, Artificial Sequence
  Description of Artificial Sequence: Synthetic oligonucleotide
cauugagguuggagucugu

SEQ ID NO: 3327 - RNA, 19 nt, Artificial Sequence
  Description of Artificial Sequence: Synthetic oligonucleotide
ccauugagguuggagucug

SEQ ID NO: 3328 - RNA, 19 nt, Artificial Sequence
  Description of Artificial Sequence: Synthetic oligonucleotide
uccauugagguuggagucu

SEQ ID NO: 3329 - RNA, 19 nt, Artificial Sequence
  Description of Artificial Sequence: Synthetic oligonucleotide
cuccauugagguuggaguc

SEQ ID NO: 3330 - RNA, 19 nt, Artificial Sequence
  Description of Artificial Sequence: Synthetic oligonucleotide
acuccauugagguuggagu

SEQ ID NO: 3331 - RNA, 19 nt, Artificial Sequence
  Description of Artificial Sequence: Synthetic oligonucleotide
cacuccauugagguuggag

SEQ ID NO: 3332 - RNA, 19 nt, Artificial Sequence
  Description of Artificial Sequence: Synthetic oligonucleotide
acacuccauugagguugga

SEQ ID NO: 3333 - RNA, 19 nt, Artificial Sequence
  Description of Artificial Sequence: Synthetic oligonucleotide
uacacuccauugagguugg

SEQ ID NO: 3334 - RNA, 19 nt, Artificial Sequence
  Description of Artificial Sequence: Synthetic oligonucleotide
guacacuccauugagguug

SEQ ID NO: 3335 - RNA, 19 nt, Artificial Sequence
  Description of Artificial Sequence: Synthetic oligonucleotide
aguacacuccauugagguu

SEQ ID NO: 3336 - RNA, 19 nt, Artificial Sequence
  Description of Artificial Sequence: Synthetic oligonucleotide
uaguacacuccauugaggu

SEQ ID NO: 3337 - RNA, 19 nt, Artificial Sequence
  Description of Artificial Sequence: Synthetic oligonucleotide
guaguacacuccauugagg

SEQ ID NO: 3338 - RNA, 19 nt, Artificial Sequence
  Description of Artificial Sequence: Synthetic oligonucleotide
gguaguacacuccauugag

SEQ ID NO: 3339 - RNA, 19 nt, Artificial Sequence
  Description of Artificial Sequence: Synthetic oligonucleotide
cgguaguacacuccauuga

SEQ ID NO: 3340 - RNA, 19 nt, Artificial Sequence
  Description of Artificial Sequence: Synthetic oligonucleotide
gcgguaguacacuccauug

SEQ ID NO: 3341 - RNA, 19 nt, Artificial Sequence
  Description of Artificial Sequence: Synthetic oligonucleotide
ggcgguaguacacuccauu

SEQ ID NO: 3342 - RNA, 19 nt, Artificial Sequence
  Description of Artificial Sequence: Synthetic oligonucleotide
aggcgguaguacacuccau

SEQ ID NO: 3343 - RNA, 19 nt, Artificial Sequence
  Description of Artificial Sequence: Synthetic oligonucleotide
caggcgguaguacacucca

SEQ ID NO: 3344 - RNA, 19 nt, Artificial Sequence
  Description of Artificial Sequence: Synthetic oligonucleotide
ccaggcgguaguacacucc

SEQ ID NO: 3345 - RNA, 19 nt, Artificial Sequence
  Description of Artificial Sequence: Synthetic oligonucleotide
cccaggcgguaguacacuc

SEQ ID NO: 3346 - RNA, 19 nt, Artificial Sequence
  Description of Artificial Sequence: Synthetic oligonucleotide
acccaggcgguaguacacu

SEQ ID NO: 3347 - RNA, 19 nt, Artificial Sequence
  Description of Artificial Sequence: Synthetic oligonucleotide
cacccaggcgguaguacac

SEQ ID NO: 3348 - RNA, 19 nt, Artificial Sequence
  Description of Artificial Sequence: Synthetic oligonucleotide
ucacccaggcgguaguaca

SEQ ID NO: 3349 - RNA, 19 nt, Artificial Sequence
  Description of Artificial Sequence: Synthetic oligonucleotide
cucacccaggcgguaguac

SEQ ID NO: 3350 - RNA, 19 nt, Artificial Sequence
  Description of Artificial Sequence: Synthetic oligonucleotide
gcucacccaggcgguagua

SEQ ID NO: 3351 - RNA, 19 nt, Artificial Sequence
  Description of Artificial Sequence: Synthetic oligonucleotide
ugcucacccaggcgguagu

SEQ ID NO: 3352 - RNA, 19 nt, Artificial Sequence
  Description of Artificial Sequence: Synthetic oligonucleotide
gugcucacccaggcgguag

SEQ ID NO: 3353 - RNA, 19 nt, Artificial Sequence
  Description of Artificial Sequence: Synthetic oligonucleotide
ugugcucacccaggcggua

SEQ ID NO: 3354 - RNA, 19 nt, Artificial Sequence
  Description of Artificial Sequence: Synthetic oligonucleotide
uugugcucacccaggcggu

SEQ ID NO: 3355 - RNA, 19 nt, Artificial Sequence
  Description of Artificial Sequence: Synthetic oligonucleotide
auugugcucacccaggcgg

SEQ ID NO: 3356 - RNA, 19 nt, Artificial Sequence
  Description of Artificial Sequence: Synthetic oligonucleotide
uauugugcucacccaggcg

SEQ ID NO: 3357 - RNA, 19 nt, Artificial Sequence
  Description of Artificial Sequence: Synthetic oligonucleotide
uuauugugcucacccaggc

SEQ ID NO: 3358 - RNA, 19 nt, Artificial Sequence
  Description of Artificial Sequence: Synthetic oligonucleotide
cuuauugugcucacccagg

SEQ ID NO: 3359 - RNA, 19 nt, Artificial Sequence
  Description of Artificial Sequence: Synthetic oligonucleotide
gcuuauugugcucacccag

SEQ ID NO: 3360 - RNA, 19 nt, Artificial Sequence
  Description of Artificial Sequence: Synthetic oligonucleotide
ugcuuauugugcucaccca

SEQ ID NO: 3361 - RNA, 19 nt, Artificial Sequence
  Description of Artificial Sequence: Synthetic oligonucleotide
gugcuuauugugcucaccc

SEQ ID NO: 3362 - RNA, 19 nt, Artificial Sequence
  Description of Artificial Sequence: Synthetic oligonucleotide
ggugcuuauugugcucacc

SEQ ID NO: 3363 - RNA, 19 nt, Artificial Sequence
  Description of Artificial Sequence: Synthetic oligonucleotide
aggugcuuauugugcucac

SEQ ID NO: 3364 - RNA, 19 nt, Artificial Sequence
  Description of Artificial Sequence: Synthetic oligonucleotide
caggugcuuauugugcuca

SEQ ID NO: 3365 - RNA, 19 nt, Artificial Sequence
  Description of Artificial Sequence: Synthetic oligonucleotide
ccaggugcuuauugugcuc

SEQ ID NO: 3366 - RNA, 19 nt, Artificial Sequence
  Description of Artificial Sequence: Synthetic oligonucleotide
uccaggugcuuauugugcu

SEQ ID NO: 3367 - RNA, 19 nt, Artificial Sequence
  Description of Artificial Sequence: Synthetic oligonucleotide
auccaggugcuuauugugc

SEQ ID NO: 3368 - RNA, 19 nt, Artificial Sequence
  Description of Artificial Sequence: Synthetic oligonucleotide
cauccaggugcuuauugug

SEQ ID NO: 3369 - RNA, 19 nt, Artificial Sequence
  Description of Artificial Sequence: Synthetic oligonucleotide
ccauccaggugcuuauugu

SEQ ID NO: 3370 - RNA, 19 nt, Artificial Sequence
  Description of Artificial Sequence: Synthetic oligonucleotide
gccauccaggugcuuauug

SEQ ID NO: 3371 - RNA, 19 nt, Artificial Sequence
  Description of Artificial Sequence: Synthetic oligonucleotide
ugccauccaggugcuuauu

SEQ ID NO: 3372 - RNA, 19 nt, Artificial Sequence
  Description of Artificial Sequence: Synthetic oligonucleotide
augccauccaggugcuuau

SEQ ID NO: 3373 - RNA, 19 nt, Artificial Sequence
  Description of Artificial Sequence: Synthetic oligonucleotide
gaugccauccaggugcuua

SEQ ID NO: 3374 - RNA, 19 nt, Artificial Sequence
  Description of Artificial Sequence: Synthetic oligonucleotide
ugaugccauccaggugcuu

SEQ ID NO: 3375 - RNA, 19 nt, Artificial Sequence
  Description of Artificial Sequence: Synthetic oligonucleotide
gugaugccauccaggugcu

SEQ ID NO: 3376 - RNA, 19 nt, Artificial Sequence
  Description of Artificial Sequence: Synthetic oligonucleotide
ggugaugccauccaggugc

SEQ ID NO: 3377 - RNA, 19 nt, Artificial Sequence
  Description of Artificial Sequence: Synthetic oligonucleotide
aggugaugccauccaggug

SEQ ID NO: 3378 - RNA, 19 nt, Artificial Sequence
  Description of Artificial Sequence: Synthetic oligonucleotide
caggugaugccauccaggu

SEQ ID NO: 3379 - RNA, 19 nt, Artificial Sequence
  Description of Artificial Sequence: Synthetic oligonucleotide
ccaggugaugccauccagg

SEQ ID NO: 3380 - RNA, 19 nt, Artificial Sequence
  Description of Artificial Sequence: Synthetic oligonucleotide
accaggugaugccauccag

SEQ ID NO: 3381 - RNA, 19 nt, Artificial Sequence
  Description of Artificial Sequence: Synthetic oligonucleotide
uaccaggugaugccaucca

SEQ ID NO: 3382 - RNA, 19 nt, Artificial Sequence
  Description of Artificial Sequence: Synthetic oligonucleotide
auaccaggugaugccaucc

SEQ ID NO: 3383 - RNA, 19 nt, Artificial Sequence
  Description of Artificial Sequence: Synthetic oligonucleotide
cauaccaggugaugccauc

SEQ ID NO: 3384 - RNA, 19 nt, Artificial Sequence
  Description of Artificial Sequence: Synthetic oligonucleotide
ccauaccaggugaugccau

SEQ ID NO: 3385 - RNA, 19 nt, Artificial Sequence
  Description of Artificial Sequence: Synthetic oligonucleotide
gccauaccaggugaugcca

SEQ ID NO: 3386 - RNA, 19 nt, Artificial Sequence
  Description of Artificial Sequence: Synthetic oligonucleotide
agccauaccaggugaugcc

SEQ ID NO: 3387 - RNA, 19 nt, Artificial Sequence
  Description of Artificial Sequence: Synthetic oligonucleotide
cagccauaccaggugaugc

SEQ ID NO: 3388 - RNA, 19 nt, Artificial Sequence
  Description of Artificial Sequence: Synthetic oligonucleotide
ccagccauaccaggugaug

SEQ ID NO: 3389 - RNA, 19 nt, Artificial Sequence
  Description of Artificial Sequence: Synthetic oligonucleotide
gccagccauaccaggugau

SEQ ID NO: 3390 - RNA, 19 nt, Artificial Sequence
  Description of Artificial Sequence: Synthetic oligonucleotide
ugccagccauaccagguga

SEQ ID NO: 3391 - RNA, 19 nt, Artificial Sequence
  Description of Artificial Sequence: Synthetic oligonucleotide
augccagccauaccaggug

SEQ ID NO: 3392 - RNA, 19 nt, Artificial Sequence
  Description of Artificial Sequence: Synthetic oligonucleotide
caugccagccauaccaggu

SEQ ID NO: 3393 - RNA, 19 nt, Artificial Sequence
  Description of Artificial Sequence: Synthetic oligonucleotide
ccaugccagccauaccagg

SEQ ID NO: 3394 - RNA, 19 nt, Artificial Sequence
  Description of Artificial Sequence: Synthetic oligonucleotide
uccaugccagccauaccag

SEQ ID NO: 3395 - RNA, 19 nt, Artificial Sequence
  Description of Artificial Sequence: Synthetic oligonucleotide
auccaugccagccauacca

SEQ ID NO: 3396 - RNA, 19 nt, Artificial Sequence
  Description of Artificial Sequence: Synthetic oligonucleotide
gauccaugccagccauacc

SEQ ID NO: 3397 - RNA, 19 nt, Artificial Sequence
  Description of Artificial Sequence: Synthetic oligonucleotide
agauccaugccagccauac

SEQ ID NO: 3398 - RNA, 19 nt, Artificial Sequence
  Description of Artificial Sequence: Synthetic oligonucleotide
uagauccaugccagccaua

SEQ ID NO: 3399 - RNA, 19 nt, Artificial Sequence
  Description of Artificial Sequence: Synthetic oligonucleotide
guagauccaugccagccau

SEQ ID NO: 3400 - RNA, 19 nt, Artificial Sequence
  Description of Artificial Sequence: Synthetic oligonucleotide
gguagauccaugccagcca

SEQ ID NO: 3401 - RNA, 19 nt, Artificial Sequence
  Description of Artificial Sequence: Synthetic oligonucleotide
agguagauccaugccagcc

SEQ ID NO: 3402 - RNA, 19 nt, Artificial Sequence
  Description of Artificial Sequence: Synthetic oligonucleotide
uagguagauccaugccagc

SEQ ID NO: 3403 - RNA, 19 nt, Artificial Sequence
  Description of Artificial Sequence: Synthetic oligonucleotide
guagguagauccaugccag

SEQ ID NO: 3404 - RNA, 19 nt, Artificial Sequence
  Description of Artificial Sequence: Synthetic oligonucleotide
aguagguagauccaugcca

SEQ ID NO: 3405 - RNA, 19 nt, Artificial Sequence
  Description of Artificial Sequence: Synthetic oligonucleotide
gaguagguagauccaugcc

SEQ ID NO: 3406 - RNA, 19 nt, Artificial Sequence
  Description of Artificial Sequence: Synthetic oligonucleotide
ggaguagguagauccaugc

SEQ ID NO: 3407 - RNA, 19 nt, Artificial Sequence
  Description of Artificial Sequence: Synthetic oligonucleotide
gggaguagguagauccaug

SEQ ID NO: 3408 - RNA, 19 nt, Artificial Sequence
  Description of Artificial Sequence: Synthetic oligonucleotide
agggaguagguagauccau

SEQ ID NO: 3409 - RNA, 19 nt, Artificial Sequence
  Description of Artificial Sequence: Synthetic oligonucleotide
gagggaguagguagaucca

SEQ ID NO: 3410 - RNA, 19 nt, Artificial Sequence
  Description of Artificial Sequence: Synthetic oligonucleotide
ugagggaguagguagaucc

SEQ ID NO: 3411 - RNA, 19 nt, Artificial Sequence
  Description of Artificial Sequence: Synthetic oligonucleotide
uugagggaguagguagauc

SEQ ID NO: 3412 - RNA, 19 nt, Artificial Sequence
  Description of Artificial Sequence: Synthetic oligonucleotide
uuugagggaguagguagau

SEQ ID NO: 3413 - RNA, 19 nt, Artificial Sequence
  Description of Artificial Sequence: Synthetic oligonucleotide
guuugagggaguagguaga

SEQ ID NO: 3414 - RNA, 19 nt, Artificial Sequence
  Description of Artificial Sequence: Synthetic oligonucleotide
cguuugagggaguagguag

SEQ ID NO: 3415 - RNA, 19 nt, Artificial Sequence
  Description of Artificial Sequence: Synthetic oligonucleotide
ccguuugagggaguaggua

SEQ ID NO: 3416 - RNA, 19 nt, Artificial Sequence
  Description of Artificial Sequence: Synthetic oligonucleotide
cccguuugagggaguaggu

SEQ ID NO: 3417 - RNA, 19 nt, Artificial Sequence
  Description of Artificial Sequence: Synthetic oligonucleotide
acccguuugagggaguagg

SEQ ID NO: 3418 - RNA, 19 nt, Artificial Sequence
  Description of Artificial Sequence: Synthetic oligonucleotide
cacccguuugagggaguag

SEQ ID NO: 3419 - RNA, 19 nt, Artificial Sequence
  Description of Artificial Sequence: Synthetic oligonucleotide
ccacccguuugagggagua

SEQ ID NO: 3420 - RNA, 19 nt, Artificial Sequence
  Description of Artificial Sequence: Synthetic oligonucleotide
uccacccguuugagggagu

SEQ ID NO: 3421 - RNA, 19 nt, Artificial Sequence
  Description of Artificial Sequence: Synthetic oligonucleotide
cuccacccguuugagggag

SEQ ID NO: 3422 - RNA, 19 nt, Artificial Sequence
  Description of Artificial Sequence: Synthetic oligonucleotide
ucuccacccguuugaggga

SEQ ID NO: 3423 - RNA, 19 nt, Artificial Sequence
  Description of Artificial Sequence: Synthetic oligonucleotide
aucuccacccguuugaggg

SEQ ID NO: 3424 - RNA, 19 nt, Artificial Sequence
  Description of Artificial Sequence: Synthetic oligonucleotide
caucuccacccguuugagg

SEQ ID NO: 3425 - RNA, 19 nt, Artificial Sequence
  Description of Artificial Sequence: Synthetic oligonucleotide
ucaucuccacccguuugag

SEQ ID NO: 3426 - RNA, 19 nt, Artificial Sequence
  Description of Artificial Sequence: Synthetic oligonucleotide
uucaucuccacccguuuga

SEQ ID NO: 3427 - RNA, 19 nt, Artificial Sequence
  Description of Artificial Sequence: Synthetic oligonucleotide
uuucaucuccacccguuug

SEQ ID NO: 3428 - RNA, 19 nt, Artificial Sequence
  Description of Artificial Sequence: Synthetic oligonucleotide
uuuucaucuccacccguuu

SEQ ID NO: 3429 - RNA, 19 nt, Artificial Sequence
  Description of Artificial Sequence: Synthetic oligonucleotide
auuuucaucuccacccguu

SEQ ID NO: 3430 - RNA, 19 nt, Artificial Sequence
  Description of Artificial Sequence: Synthetic oligonucleotide
gauuuucaucuccacccgu

SEQ ID NO: 3431 - RNA, 19 nt, Artificial Sequence
  Description of Artificial Sequence: Synthetic oligonucleotide
ggauuuucaucuccacccg

SEQ ID NO: 3432 - RNA, 19 nt, Artificial Sequence
  Description of Artificial Sequence: Synthetic oligonucleotide
cggauuuucaucuccaccc

SEQ ID NO: 3433 - RNA, 19 nt, Artificial Sequence
  Description of Artificial Sequence: Synthetic oligonucleotide
gcggauuuucaucuccacc

SEQ ID NO: 3434 - RNA, 19 nt, Artificial Sequence
  Description of Artificial Sequence: Synthetic oligonucleotide
ggcggauuuucaucuccac

SEQ ID NO: 3435 - RNA, 19 nt, Artificial Sequence
  Description of Artificial Sequence: Synthetic oligonucleotide
gggcggauuuucaucucca

SEQ ID NO: 3436 - RNA, 19 nt, Artificial Sequence
  Description of Artificial Sequence: Synthetic oligonucleotide
ugggcggauuuucaucucc

SEQ ID NO: 3437 - RNA, 19 nt, Artificial Sequence
  Description of Artificial Sequence: Synthetic oligonucleotide
cugggcggauuuucaucuc

SEQ ID NO: 3438 - RNA, 19 nt, Artificial Sequence
  Description of Artificial Sequence: Synthetic oligonucleotide
ucugggcggauuuucaucu

SEQ ID NO: 3439 - RNA, 19 nt, Artificial Sequence
  Description of Artificial Sequence: Synthetic oligonucleotide
uucugggcggauuuucauc

SEQ ID NO: 3440 - RNA, 19 nt, Artificial Sequence
  Description of Artificial Sequence: Synthetic oligonucleotide
cuucugggcggauuuucau

SEQ ID NO: 3441 - RNA, 19 nt, Artificial Sequence
  Description of Artificial Sequence: Synthetic oligonucleotide
ucuucugggcggauuuuca

SEQ ID NO: 3442 - RNA, 19 nt, Artificial Sequence
  Description of Artificial Sequence: Synthetic oligonucleotide
gucuucugggcggauuuuc

SEQ ID NO: 3443 - RNA, 19 nt, Artificial Sequence
  Description of Artificial Sequence: Synthetic oligonucleotide
agucuucugggcggauuuu

SEQ ID NO: 3444 - RNA, 19 nt, Artificial Sequence
  Description of Artificial Sequence: Synthetic oligonucleotide
aagucuucugggcggauuu

SEQ ID NO: 3445 - RNA, 19 nt, Artificial Sequence
  Description of Artificial Sequence: Synthetic oligonucleotide
gaagucuucugggcggauu

SEQ ID NO: 3446 - RNA, 19 nt, Artificial Sequence
  Description of Artificial Sequence: Synthetic oligonucleotide
ugaagucuucugggcggau

SEQ ID NO: 3447 - RNA, 19 nt, Artificial Sequence
  Description of Artificial Sequence: Synthetic oligonucleotide
uugaagucuucugggcgga

SEQ ID NO: 3448 - RNA, 19 nt, Artificial Sequence
  Description of Artificial Sequence: Synthetic oligonucleotide
cuugaagucuucugggcgg

SEQ ID NO: 3449 - RNA, 19 nt, Artificial Sequence
  Description of Artificial Sequence: Synthetic oligonucleotide
gcuugaagucuucugggcg

SEQ ID NO: 3450 - RNA, 19 nt, Artificial Sequence
  Description of Artificial Sequence: Synthetic oligonucleotide
ggcuugaagucuucugggc

SEQ ID NO: 3451 - RNA, 19 nt, Artificial Sequence
  Description of Artificial Sequence: Synthetic oligonucleotide
aggcuugaagucuucuggg

SEQ ID NO: 3452 - RNA, 19 nt, Artificial Sequence
  Description of Artificial Sequence: Synthetic oligonucleotide
aaggcuugaagucuucugg

SEQ ID NO: 3453 - RNA, 19 nt, Artificial Sequence
  Description of Artificial Sequence: Synthetic oligonucleotide
uaaggcuugaagucuucug

SEQ ID NO: 3454 - RNA, 19 nt, Artificial Sequence
  Description of Artificial Sequence: Synthetic oligonucleotide
uuaaggcuugaagucuucu

SEQ ID NO: 3455 - RNA, 19 nt, Artificial Sequence
  Description of Artificial Sequence: Synthetic oligonucleotide
uuuaaggcuugaagucuuc

SEQ ID NO: 3456 - RNA, 19 nt, Artificial Sequence
  Description of Artificial Sequence: Synthetic oligonucleotide
uuuuaaggcuugaagucuu

SEQ ID NO: 3457 - RNA, 19 nt, Artificial Sequence
  Description of Artificial Sequence: Synthetic oligonucleotide
cuuuuaaggcuugaagucu

SEQ ID NO: 3458 - RNA, 19 nt, Artificial Sequence
  Description of Artificial Sequence: Synthetic oligonucleotide
ccuuuuaaggcuugaaguc

SEQ ID NO: 3459 - RNA, 19 nt, Artificial Sequence
  Description of Artificial Sequence: Synthetic oligonucleotide
uccuuuuaaggcuugaagu

SEQ ID NO: 3460 - RNA, 19 nt, Artificial Sequence
  Description of Artificial Sequence: Synthetic oligonucleotide
cuccuuuuaaggcuugaag

SEQ ID NO: 3461 - RNA, 19 nt, Artificial Sequence
  Description of Artificial Sequence: Synthetic oligonucleotide
ccuccuuuuaaggcuugaa

SEQ ID NO: 3462 - RNA, 19 nt, Artificial Sequence
  Description of Artificial Sequence: Synthetic oligonucleotide
gccuccuuuuaaggcuuga

SEQ ID NO: 3463 - RNA, 19 nt, Artificial Sequence
  Description of Artificial Sequence: Synthetic oligonucleotide
agccuccuuuuaaggcuug

SEQ ID NO: 3464 - RNA, 19 nt, Artificial Sequence
  Description of Artificial Sequence: Synthetic oligonucleotide
cagccuccuuuuaaggcuu

SEQ ID NO: 3465 - RNA, 19 nt, Artificial Sequence
  Description of Artificial Sequence: Synthetic oligonucleotide
gcagccuccuuuuaaggcu

SEQ ID NO: 3466 - RNA, 19 nt, Artificial Sequence
  Description of Artificial Sequence: Synthetic oligonucleotide
ggcagccuccuuuuaaggc

SEQ ID NO: 3467 - RNA, 19 nt, Artificial Sequence
  Description of Artificial Sequence: Synthetic oligonucleotide
cggcagccuccuuuuaagg

SEQ ID NO: 3468 - RNA, 19 nt, Artificial Sequence
  Description of Artificial Sequence: Synthetic oligonucleotide
acggcagccuccuuuuaag

SEQ ID NO: 3469 - RNA, 19 nt, Artificial Sequence
  Description of Artificial Sequence: Synthetic oligonucleotide
cacggcagccuccuuuuaa

SEQ ID NO: 3470 - RNA, 19 nt, Artificial Sequence
  Description of Artificial Sequence: Synthetic oligonucleotide
ccacggcagccuccuuuua

SEQ ID NO: 3471 - RNA, 19 nt, Artificial Sequence
  Description of Artificial Sequence: Synthetic oligonucleotide
uccacggcagccuccuuuu

SEQ ID NO: 3472 - RNA, 19 nt, Artificial Sequence
  Description of Artificial Sequence: Synthetic oligonucleotide
cuccacggcagccuccuuu

SEQ ID NO: 3473 - RNA, 19 nt, Artificial Sequence
  Description of Artificial Sequence: Synthetic oligonucleotide
gcuccacggcagccuccuu

SEQ ID NO: 3474 - RNA, 19 nt, Artificial Sequence
  Description of Artificial Sequence: Synthetic oligonucleotide
ugcuccacggcagccuccu

SEQ ID NO: 3475 - RNA, 19 nt, Artificial Sequence
  Description of Artificial Sequence: Synthetic oligonucleotide
gugcuccacggcagccucc

SEQ ID NO: 3476 - RNA, 19 nt, Artificial Sequence
  Description of Artificial Sequence: Synthetic oligonucleotide
cgugcuccacggcagccuc

SEQ ID NO: 3477 - RNA, 19 nt, Artificial Sequence
  Description of Artificial Sequence: Synthetic oligonucleotide
ccgugcuccacggcagccu

SEQ ID NO: 3478 - RNA, 19 nt, Artificial Sequence
  Description of Artificial Sequence: Synthetic oligonucleotide
uccgugcuccacggcagcc

SEQ ID NO: 3479 - RNA, 19 nt, Artificial Sequence
  Description of Artificial Sequence: Synthetic oligonucleotide
auccgugcuccacggcagc

SEQ ID NO: 3480 - RNA, 19 nt, Artificial Sequence
  Description of Artificial Sequence: Synthetic oligonucleotide
uauccgugcuccacggcag

SEQ ID NO: 3481 - RNA, 19 nt, Artificial Sequence
  Description of Artificial Sequence: Synthetic oligonucleotide
guauccgugcuccacggca

SEQ ID NO: 3482 - RNA, 19 nt, Artificial Sequence
  Description of Artificial Sequence: Synthetic oligonucleotide
uguauccgugcuccacggc

SEQ ID NO: 3483 - RNA, 19 nt, Artificial Sequence
  Description of Artificial Sequence: Synthetic oligonucleotide
cuguauccgugcuccacgg

SEQ ID NO: 3484 - RNA, 19 nt, Artificial Sequence
  Description of Artificial Sequence: Synthetic oligonucleotide
ucuguauccgugcuccacg

SEQ ID NO: 3485 - RNA, 19 nt, Artificial Sequence
  Description of Artificial Sequence: Synthetic oligonucleotide
uucuguauccgugcuccac

SEQ ID NO: 3486 - RNA, 19 nt, Artificial Sequence
  Description of Artificial Sequence: Synthetic oligonucleotide
uuucuguauccgugcucca

SEQ ID NO: 3487 - RNA, 19 nt, Artificial Sequence
  Description of Artificial Sequence: Synthetic oligonucleotide
guuucuguauccgugcucc

SEQ ID NO: 3488 - RNA, 19 nt, Artificial Sequence
  Description of Artificial Sequence: Synthetic oligonucleotide
aguuucuguauccgugcuc

SEQ ID NO: 3489 - RNA, 19 nt, Artificial Sequence
  Description of Artificial Sequence: Synthetic oligonucleotide
caguuucuguauccgugcu

SEQ ID NO: 3490 - RNA, 19 nt, Artificial Sequence
  Description of Artificial Sequence: Synthetic oligonucleotide
ucaguuucuguauccgugc

SEQ ID NO: 3491 - RNA, 19 nt, Artificial Sequence
  Description of Artificial Sequence: Synthetic oligonucleotide
cucaguuucuguauccgug

SEQ ID NO: 3492 - RNA, 19 nt, Artificial Sequence
  Description of Artificial Sequence: Synthetic oligonucleotide
ucucaguuucuguauccgu

SEQ ID NO: 3493 - RNA, 19 nt, Artificial Sequence
  Description of Artificial Sequence: Synthetic oligonucleotide
gucucaguuucuguauccg

SEQ ID NO: 3494 - RNA, 19 nt, Artificial Sequence
  Description of Artificial Sequence: Synthetic oligonucleotide
ugucucaguuucuguaucc

SEQ ID NO: 3495 - RNA, 19 nt, Artificial Sequence
  Description of Artificial Sequence: Synthetic oligonucleotide
gugucucaguuucuguauc

SEQ ID NO: 3496 - RNA, 19 nt, Artificial Sequence
  Description of Artificial Sequence: Synthetic oligonucleotide
cgugucucaguuucuguau

SEQ ID NO: 3497 - RNA, 19 nt, Artificial Sequence
  Description of Artificial Sequence: Synthetic oligonucleotide
acgugucucaguuucugua

SEQ ID NO: 3498 - RNA, 19 nt, Artificial Sequence
  Description of Artificial Sequence: Synthetic oligonucleotide
cacgugucucaguuucugu

SEQ ID NO: 3499 - RNA, 19 nt, Artificial Sequence
  Description of Artificial Sequence: Synthetic oligonucleotide
ccacgugucucaguuucug

SEQ ID NO: 3500 - RNA, 19 nt, Artificial Sequence
  Description of Artificial Sequence: Synthetic oligonucleotide
uccacgugucucaguuucu

SEQ ID NO: 3501 - RNA, 19 nt, Artificial Sequence
  Description of Artificial Sequence: Synthetic oligonucleotide
cuccacgugucucaguuuc

SEQ ID NO: 3502 - RNA, 19 nt, Artificial Sequence
  Description of Artificial Sequence: Synthetic oligonucleotide
ucuccacgugucucaguuu

SEQ ID NO: 3503 - RNA, 19 nt, Artificial Sequence
  Description of Artificial Sequence: Synthetic oligonucleotide
gucuccacgugucucaguu

SEQ ID NO: 3504 - RNA, 19 nt, Artificial Sequence
  Description of Artificial Sequence: Synthetic oligonucleotide
agucuccacgugucucagu

SEQ ID NO: 3505 - RNA, 19 nt, Artificial Sequence
  Description of Artificial Sequence: Synthetic oligonucleotide
cagucuccacgugucucag

SEQ ID NO: 3506 - RNA, 19 nt, Artificial Sequence
  Description of Artificial Sequence: Synthetic oligonucleotide
ccagucuccacgugucuca

SEQ ID NO: 3507 - RNA, 19 nt, Artificial Sequence
  Description of Artificial Sequence: Synthetic oligonucleotide
uccagucuccacgugucuc

SEQ ID NO: 3508 - RNA, 19 nt, Artificial Sequence
  Description of Artificial Sequence: Synthetic oligonucleotide
auccagucuccacgugucu

SEQ ID NO: 3509 - RNA, 19 nt, Artificial Sequence
  Description of Artificial Sequence: Synthetic oligonucleotide
cauccagucuccacguguc

SEQ ID NO: 3510 - RNA, 19 nt, Artificial Sequence
  Description of Artificial Sequence: Synthetic oligonucleotide
ucauccagucuccacgugu

SEQ ID NO: 3511 - RNA, 19 nt, Artificial Sequence
  Description of Artificial Sequence: Synthetic oligonucleotide
cucauccagucuccacgug

SEQ ID NO: 3512 - RNA, 19 nt, Artificial Sequence
  Description of Artificial Sequence: Synthetic oligonucleotide
ccucauccagucuccacgu

SEQ ID NO: 3513 - RNA, 19 nt, Artificial Sequence
  Description of Artificial Sequence: Synthetic oligonucleotide
cccucauccagucuccacg

SEQ ID NO: 3514 - RNA, 19 nt, Artificial Sequence
  Description of Artificial Sequence: Synthetic oligonucleotide
gcccucauccagucuccac

SEQ ID NO: 3515 - RNA, 19 nt, Artificial Sequence
  Description of Artificial Sequence: Synthetic oligonucleotide
ugcccucauccagucucca

SEQ ID NO: 3516 - RNA, 19 nt, Artificial Sequence
  Description of Artificial Sequence: Synthetic oligonucleotide
cugcccucauccagucucc

SEQ ID NO: 3517 - RNA, 19 nt, Artificial Sequence
  Description of Artificial Sequence: Synthetic oligonucleotide
ucugcccucauccagucuc

SEQ ID NO: 3518 - RNA, 19 nt, Artificial Sequence
  Description of Artificial Sequence: Synthetic oligonucleotide
aucugcccucauccagucu

SEQ ID NO: 3519 - RNA, 19 nt, Artificial Sequence
  Description of Artificial Sequence: Synthetic oligonucleotide
caucugcccucauccaguc

SEQ ID NO: 3520 - RNA, 19 nt, Artificial Sequence
  Description of Artificial Sequence: Synthetic oligonucleotide
ucaucugcccucauccagu

SEQ ID NO: 3521 - RNA, 19 nt, Artificial Sequence
  Description of Artificial Sequence: Synthetic oligonucleotide
cucaucugcccucauccag

SEQ ID NO: 3522 - RNA, 19 nt, Artificial Sequence
  Description of Artificial Sequence: Synthetic oligonucleotide
ccucaucugcccucaucca

SEQ ID NO: 3523 - RNA, 19 nt, Artificial Sequence
  Description of Artificial Sequence: Synthetic oligonucleotide
uccucaucugcccucaucc

SEQ ID NO: 3524 - RNA, 19 nt, Artificial Sequence
  Description of Artificial Sequence: Synthetic oligonucleotide
guccucaucugcccucauc

SEQ ID NO: 3525 - RNA, 19 nt, Artificial Sequence
  Description of Artificial Sequence: Synthetic oligonucleotide
uguccucaucugcccucau

SEQ ID NO: 3526 - RNA, 19 nt, Artificial Sequence
  Description of Artificial Sequence: Synthetic oligonucleotide
cuguccucaucugcccuca

SEQ ID NO: 3527 - RNA, 19 nt, Artificial Sequence
  Description of Artificial Sequence: Synthetic oligonucleotide
ccuguccucaucugcccuc

SEQ ID NO: 3528 - RNA, 19 nt, Artificial Sequence
  Description of Artificial Sequence: Synthetic oligonucleotide
uccuguccucaucugcccu

SEQ ID NO: 3529 - RNA, 19 nt, Artificial Sequence
  Description of Artificial Sequence: Synthetic oligonucleotide
uuccuguccucaucugccc

SEQ ID NO: 3530 - RNA, 19 nt, Artificial Sequence
  Description of Artificial Sequence: Synthetic oligonucleotide
cuuccuguccucaucugcc

SEQ ID NO: 3531 - RNA, 19 nt, Artificial Sequence
  Description of Artificial Sequence: Synthetic oligonucleotide
ucuuccuguccucaucugc

SEQ ID NO: 3532 - RNA, 19 nt, Artificial Sequence
  Description of Artificial Sequence: Synthetic oligonucleotide
cucuuccuguccucaucug

SEQ ID NO: 3533 - RNA, 19 nt, Artificial Sequence
  Description of Artificial Sequence: Synthetic oligonucleotide
ucucuuccuguccucaucu

SEQ ID NO: 3534 - RNA, 19 nt, Artificial Sequence
  Description of Artificial Sequence: Synthetic oligonucleotide
cucucuuccuguccucauc

SEQ ID NO: 3535 - RNA, 19 nt, Artificial Sequence
  Description of Artificial Sequence: Synthetic oligonucleotide
acucucuuccuguccucau

SEQ ID NO: 3536 - RNA, 19 nt, Artificial Sequence
  Description of Artificial Sequence: Synthetic oligonucleotide
cacucucuuccuguccuca

SEQ ID NO: 3537 - RNA, 19 nt, Artificial Sequence
  Description of Artificial Sequence: Synthetic oligonucleotide
acacucucuuccuguccuc

SEQ ID NO: 3538 - RNA, 19 nt, Artificial Sequence
  Description of Artificial Sequence: Synthetic oligonucleotide
aacacucucuuccuguccu

SEQ ID NO: 3539 - RNA, 19 nt, Artificial Sequence
  Description of Artificial Sequence: Synthetic oligonucleotide
uaacacucucuuccugucc

SEQ ID NO: 3540 - RNA, 19 nt, Artificial Sequence
  Description of Artificial Sequence: Synthetic oligonucleotide
cuaacacucucuuccuguc

SEQ ID NO: 3541 - RNA, 19 nt, Artificial Sequence
  Description of Artificial Sequence: Synthetic oligonucleotide
ucuaacacucucuuccugu

SEQ ID NO: 3542 - RNA, 19 nt, Artificial Sequence
  Description of Artificial Sequence: Synthetic oligonucleotide
uucuaacacucucuuccug

SEQ ID NO: 3543 - RNA, 19 nt, Artificial Sequence
  Description of Artificial Sequence: Synthetic oligonucleotide
uuucuaacacucucuuccu

SEQ ID NO: 3544 - RNA, 19 nt, Artificial Sequence
  Description of Artificial Sequence: Synthetic oligonucleotide
cuuucuaacacucucuucc

SEQ ID NO: 3545 - RNA, 19 nt, Artificial Sequence
  Description of Artificial Sequence: Synthetic oligonucleotide
ccuuucuaacacucucuuc

SEQ ID NO: 3546 - RNA, 19 nt, Artificial Sequence
  Description of Artificial Sequence: Synthetic oligonucleotide
cccuuucuaacacucucuu

SEQ ID NO: 3547 - RNA, 19 nt, Artificial Sequence
  Description of Artificial Sequence: Synthetic oligonucleotide
acccuuucuaacacucucu

SEQ ID NO: 3548 - RNA, 19 nt, Artificial Sequence
  Description of Artificial Sequence: Synthetic oligonucleotide
uacccuuucuaacacucuc

SEQ ID NO: 3549 - RNA, 19 nt, Artificial Sequence
  Description of Artificial Sequence: Synthetic oligonucleotide
cuacccuuucuaacacucu

SEQ ID NO: 3550 - RNA, 19 nt, Artificial Sequence
  Description of Artificial Sequence: Synthetic oligonucleotide
ccuacccuuucuaacacuc

SEQ ID NO: 3551 - RNA, 19 nt, Artificial Sequence
  Description of Artificial Sequence: Synthetic oligonucleotide
uccuacccuuucuaacacu

SEQ ID NO: 3552 - RNA, 19 nt, Artificial Sequence
  Description of Artificial Sequence: Synthetic oligonucleotide
guccuacccuuucuaacac

SEQ ID NO: 3553 - RNA, 19 nt, Artificial Sequence
  Description of Artificial Sequence: Synthetic oligonucleotide
aguccuacccuuucuaaca

SEQ ID NO: 3554 - RNA, 19 nt, Artificial Sequence
  Description of Artificial Sequence: Synthetic oligonucleotide
caguccuacccuuucuaac

SEQ ID NO: 3555 - RNA, 19 nt, Artificial Sequence
  Description of Artificial Sequence: Synthetic oligonucleotide
ucaguccuacccuuucuaa

SEQ ID NO: 3556 - RNA, 19 nt, Artificial Sequence
  Description of Artificial Sequence: Synthetic oligonucleotide
cucaguccuacccuuucua

SEQ ID NO: 3557 - RNA, 19 nt, Artificial Sequence
  Description of Artificial Sequence: Synthetic oligonucleotide
ucucaguccuacccuuucu

SEQ ID NO: 3558 - RNA, 19 nt, Artificial Sequence
  Description of Artificial Sequence: Synthetic oligonucleotide
uucucaguccuacccuuuc

SEQ ID NO: 3559 - RNA, 19 nt, Artificial Sequence
  Description of Artificial Sequence: Synthetic oligonucleotide
uuucucaguccuacccuuu

SEQ ID NO: 3560 - RNA, 19 nt, Artificial Sequence
  Description of Artificial Sequence: Synthetic oligonucleotide
guuucucaguccuacccuu

SEQ ID NO: 3561 - RNA, 19 nt, Artificial Sequence
  Description of Artificial Sequence: Synthetic oligonucleotide
uguuucucaguccuacccu

SEQ ID NO: 3562 - RNA, 19 nt, Artificial Sequence
  Description of Artificial Sequence: Synthetic oligonucleotide
cuguuucucaguccuaccc

SEQ ID NO: 3563 - RNA, 19 nt, Artificial Sequence
  Description of Artificial Sequence: Synthetic oligonucleotide
gcuguuucucaguccuacc

SEQ ID NO: 3564 - RNA, 19 nt, Artificial Sequence
  Description of Artificial Sequence: Synthetic oligonucleotide
ggcuguuucucaguccuac

SEQ ID NO: 3565 - RNA, 19 nt, Artificial Sequence
  Description of Artificial Sequence: Synthetic oligonucleotide
aggcuguuucucaguccua

SEQ ID NO: 3566 - RNA, 19 nt, Artificial Sequence
  Description of Artificial Sequence: Synthetic oligonucleotide
uaggcuguuucucaguccu

SEQ ID NO: 3567 - RNA, 19 nt, Artificial Sequence
  Description of Artificial Sequence: Synthetic oligonucleotide
auaggcuguuucucagucc

SEQ ID NO: 3568 - RNA, 19 nt, Artificial Sequence
  Description of Artificial Sequence: Synthetic oligonucleotide
uauaggcuguuucucaguc

SEQ ID NO: 3569 - RNA, 19 nt, Artificial Sequence
  Description of Artificial Sequence: Synthetic oligonucleotide
uuauaggcuguuucucagu

SEQ ID NO: 3570 - RNA, 19 nt, Artificial Sequence
  Description of Artificial Sequence: Synthetic oligonucleotide
auuauaggcuguuucucag

SEQ ID NO: 3571 - RNA, 19 nt, Artificial Sequence
  Description of Artificial Sequence: Synthetic oligonucleotide
gauuauaggcuguuucuca

SEQ ID NO: 3572 - RNA, 19 nt, Artificial Sequence
  Description of Artificial Sequence: Synthetic oligonucleotide
agauuauaggcuguuucuc

SEQ ID NO: 3573 - RNA, 19 nt, Artificial Sequence
  Description of Artificial Sequence: Synthetic oligonucleotide
gagauuauaggcuguuucu

SEQ ID NO: 3574 - RNA, 19 nt, Artificial Sequence
  Description of Artificial Sequence: Synthetic oligonucleotide
ggagauuauaggcuguuuc

SEQ ID NO: 3575 - RNA, 19 nt, Artificial Sequence
  Description of Artificial Sequence: Synthetic oligonucleotide
uggagauuauaggcuguuu

SEQ ID NO: 3576 - RNA, 19 nt, Artificial Sequence
  Description of Artificial Sequence: Synthetic oligonucleotide
uuggagauuauaggcuguu

SEQ ID NO: 3577 - RNA, 19 nt, Artificial Sequence
  Description of Artificial Sequence: Synthetic oligonucleotide
uuuggagauuauaggcugu

SEQ ID NO: 3578 - RNA, 19 nt, Artificial Sequence
  Description of Artificial Sequence: Synthetic oligonucleotide
cuuuggagauuauaggcug

SEQ ID NO: 3579 - RNA, 19 nt, Artificial Sequence
  Description of Artificial Sequence: Synthetic oligonucleotide
ucuuuggagauuauaggcu

SEQ ID NO: 3580 - RNA, 19 nt, Artificial Sequence
  Description of Artificial Sequence: Synthetic oligonucleotide
uucuuuggagauuauaggc

SEQ ID NO: 3581 - RNA, 19 nt, Artificial Sequence
  Description of Artificial Sequence: Synthetic oligonucleotide
uuucuuuggagauuauagg

SEQ ID NO: 3582 - RNA, 19 nt, Artificial Sequence
  Description of Artificial Sequence: Synthetic oligonucleotide
cuuucuuuggagauuauag

SEQ ID NO: 3583 - RNA, 19 nt, Artificial Sequence
  Description of Artificial Sequence: Synthetic oligonucleotide
ucuuucuuuggagauuaua

SEQ ID NO: 3584 - RNA, 19 nt, Artificial Sequence
  Description of Artificial Sequence: Synthetic oligonucleotide
uucuuucuuuggagauuau

SEQ ID NO: 3585 - RNA, 19 nt, Artificial Sequence
  Description of Artificial Sequence: Synthetic oligonucleotide
auucuuucuuuggagauua

SEQ ID NO: 3586 - RNA, 19 nt, Artificial Sequence
  Description of Artificial Sequence: Synthetic oligonucleotide
uauucuuucuuuggagauu

SEQ ID NO: 3587 - RNA, 19 nt, Artificial Sequence
  Description of Artificial Sequence: Synthetic oligonucleotide
uuauucuuucuuuggagau

SEQ ID NO: 3588 - RNA, 19 nt, Artificial Sequence
  Description of Artificial Sequence: Synthetic oligonucleotide
cuuauucuuucuuuggaga

SEQ ID NO: 3589 - RNA, 19 nt, Artificial Sequence
  Description of Artificial Sequence: Synthetic oligonucleotide
acuuauucuuucuuuggag

SEQ ID NO: 3590 - RNA, 19 nt, Artificial Sequence
  Description of Artificial Sequence: Synthetic oligonucleotide
gacuuauucuuucuuugga

SEQ ID NO: 3591 - RNA, 19 nt, Artificial Sequence
  Description of Artificial Sequence: Synthetic oligonucleotide
agacuuauucuuucuuugg

SEQ ID NO: 3592 - RNA, 19 nt, Artificial Sequence
  Description of Artificial Sequence: Synthetic oligonucleotide
gagacuuauucuuucuuug

SEQ ID NO: 3593 - RNA, 19 nt, Artificial Sequence
  Description of Artificial Sequence: Synthetic oligonucleotide
ggagacuuauucuuucuuu

SEQ ID NO: 3594 - RNA, 19 nt, Artificial Sequence
  Description of Artificial Sequence: Synthetic oligonucleotide
uggagacuuauucuuucuu

SEQ ID NO: 3595 - RNA, 19 nt, Artificial Sequence
  Description of Artificial Sequence: Synthetic oligonucleotide
uuggagacuuauucuuucu

SEQ ID NO: 3596 - RNA, 19 nt, Artificial Sequence
  Description of Artificial Sequence: Synthetic oligonucleotide
cuuggagacuuauucuuuc

SEQ ID NO: 3597 - RNA, 19 nt, Artificial Sequence
  Description of Artificial Sequence: Synthetic oligonucleotide
ccuuggagacuuauucuuu

SEQ ID NO: 3598 - RNA, 19 nt, Artificial Sequence
  Description of Artificial Sequence: Synthetic oligonucleotide
uccuuggagacuuauucuu

SEQ ID NO: 3599 - RNA, 19 nt, Artificial Sequence
  Description of Artificial Sequence: Synthetic oligonucleotide
cuccuuggagacuuauucu

SEQ ID NO: 3600 - RNA, 19 nt, Artificial Sequence
  Description of Artificial Sequence: Synthetic oligonucleotide
gcuccuuggagacuuauuc

SEQ ID NO: 3601 - RNA, 19 nt, Artificial Sequence
  Description of Artificial Sequence: Synthetic oligonucleotide
ugcuccuuggagacuuauu

SEQ ID NO: 3602 - RNA, 19 nt, Artificial Sequence
  Description of Artificial Sequence: Synthetic oligonucleotide
gugcuccuuggagacuuau

SEQ ID NO: 3603 - RNA, 19 nt, Artificial Sequence
  Description of Artificial Sequence: Synthetic oligonucleotide
ugugcuccuuggagacuua

SEQ ID NO: 3604 - RNA, 19 nt, Artificial Sequence
  Description of Artificial Sequence: Synthetic oligonucleotide
uugugcuccuuggagacuu

SEQ ID NO: 3605 - RNA, 19 nt, Artificial Sequence
  Description of Artificial Sequence: Synthetic oligonucleotide
uuugugcuccuuggagacu

SEQ ID NO: 3606 - RNA, 19 nt, Artificial Sequence
  Description of Artificial Sequence: Synthetic oligonucleotide
uuuugugcuccuuggagac

SEQ ID NO: 3607 - RNA, 19 nt, Artificial Sequence
  Description of Artificial Sequence: Synthetic oligonucleotide
uuuuugugcuccuuggaga

SEQ ID NO: 3608 - RNA, 19 nt, Artificial Sequence
  Description of Artificial Sequence: Synthetic oligonucleotide
uuuuuugugcuccuuggag

SEQ ID NO: 3609 - RNA, 19 nt, Artificial Sequence
  Description of Artificial Sequence: Synthetic oligonucleotide
uuuuuuugugcuccuugga

SEQ ID NO: 3610 - RNA, 19 nt, Artificial Sequence
  Description of Artificial Sequence: Synthetic oligonucleotide
auuuuuuugugcuccuugg

SEQ ID NO: 3611 - RNA, 19 nt, Artificial Sequence
  Description of Artificial Sequence: Synthetic oligonucleotide
gauuuuuuugugcuccuug

SEQ ID NO: 3612 - RNA, 19 nt, Artificial Sequence
  Description of Artificial Sequence: Synthetic oligonucleotide
ugauuuuuuugugcuccuu

SEQ ID NO: 3613 - RNA, 19 nt, Artificial Sequence
  Description of Artificial Sequence: Synthetic oligonucleotide
augauuuuuuugugcuccu

SEQ ID NO: 3614 - RNA, 19 nt, Artificial Sequence
  Description of Artificial Sequence: Synthetic oligonucleotide
uaugauuuuuuugugcucc

SEQ ID NO: 3615 - RNA, 19 nt, Artificial Sequence
  Description of Artificial Sequence: Synthetic oligonucleotide
auaugauuuuuuugugcuc

SEQ ID NO: 3616 - RNA, 19 nt, Artificial Sequence
  Description of Artificial Sequence: Synthetic oligonucleotide
cauaugauuuuuuugugcu

SEQ ID NO: 3617 - RNA, 19 nt, Artificial Sequence
  Description of Artificial Sequence: Synthetic oligonucleotide
acauaugauuuuuuugugc

SEQ ID NO: 3618 - RNA, 19 nt, Artificial Sequence
  Description of Artificial Sequence: Synthetic oligonucleotide
uacauaugauuuuuuugug

SEQ ID NO: 3619 - RNA, 19 nt, Artificial Sequence
  Description of Artificial Sequence: Synthetic oligonucleotide
guacauaugauuuuuuugu

SEQ ID NO: 3620 - RNA, 19 nt, Artificial Sequence
  Description of Artificial Sequence: Synthetic oligonucleotide
gguacauaugauuuuuuug

SEQ ID NO: 3621 - RNA, 19 nt, Artificial Sequence
  Description of Artificial Sequence: Synthetic oligonucleotide
ugguacauaugauuuuuuu

SEQ ID NO: 3622 - RNA, 19 nt, Artificial Sequence
  Description of Artificial Sequence: Synthetic oligonucleotide
uugguacauaugauuuuuu

SEQ ID NO: 3623 - RNA, 19 nt, Artificial Sequence
  Description of Artificial Sequence: Synthetic oligonucleotide
cuugguacauaugauuuuu

SEQ ID NO: 3624 - RNA, 19 nt, Artificial Sequence
  Description of Artificial Sequence: Synthetic oligonucleotide
ccuugguacauaugauuuu

SEQ ID NO: 3625 - RNA, 19 nt, Artificial Sequence
  Description of Artificial Sequence: Synthetic oligonucleotide
uccuugguacauaugauuu

SEQ ID NO: 3626 - RNA, 19 nt, Artificial Sequence
  Description of Artificial Sequence: Synthetic oligonucleotide
auccuugguacauaugauu

SEQ ID NO: 3627 - RNA, 19 nt, Artificial Sequence
  Description of Artificial Sequence: Synthetic oligonucleotide
cauccuugguacauaugau

SEQ ID NO: 3628 - RNA, 19 nt, Artificial Sequence
  Description of Artificial Sequence: Synthetic oligonucleotide
acauccuugguacauauga

SEQ ID NO: 3629 - RNA, 19 nt, Artificial Sequence
  Description of Artificial Sequence: Synthetic oligonucleotide
aacauccuugguacauaug

SEQ ID NO: 3630 - RNA, 19 nt, Artificial Sequence
  Description of Artificial Sequence: Synthetic oligonucleotide
uaacauccuugguacauau

SEQ ID NO: 3631 - RNA, 19 nt, Artificial Sequence
  Description of Artificial Sequence: Synthetic oligonucleotide
guaacauccuugguacaua

SEQ ID NO: 3632 - RNA, 19 nt, Artificial Sequence
  Description of Artificial Sequence: Synthetic oligonucleotide
uguaacauccuugguacau

SEQ ID NO: 3633 - RNA, 19 nt, Artificial Sequence
  Description of Artificial Sequence: Synthetic oligonucleotide
cuguaacauccuugguaca

SEQ ID NO: 3634 - RNA, 19 nt, Artificial Sequence
  Description of Artificial Sequence: Synthetic oligonucleotide
acuguaacauccuugguac

SEQ ID NO: 3635 - RNA, 19 nt, Artificial Sequence
  Description of Artificial Sequence: Synthetic oligonucleotide
uacuguaacauccuuggua

SEQ ID NO: 3636 - RNA, 19 nt, Artificial Sequence
  Description of Artificial Sequence: Synthetic oligonucleotide
uuacuguaacauccuuggu

SEQ ID NO: 3637 - RNA, 19 nt, Artificial Sequence
  Description of Artificial Sequence: Synthetic oligonucleotide
uuuacuguaacauccuugg

SEQ ID NO: 3638 - RNA, 19 nt, Artificial Sequence
  Description of Artificial Sequence: Synthetic oligonucleotide
guuuacuguaacauccuug

SEQ ID NO: 3639 - RNA, 19 nt, Artificial Sequence
  Description of Artificial Sequence: Synthetic oligonucleotide
uguuuacuguaacauccuu

SEQ ID NO: 3640 - RNA, 19 nt, Artificial Sequence
  Description of Artificial Sequence: Synthetic oligonucleotide
cuguuuacuguaacauccu

SEQ ID NO: 3641 - RNA, 19 nt, Artificial Sequence
  Description of Artificial Sequence: Synthetic oligonucleotide
ccuguuuacuguaacaucc

SEQ ID NO: 3642 - RNA, 19 nt, Artificial Sequence
  Description of Artificial Sequence: Synthetic oligonucleotide
uccuguuuacuguaacauc

SEQ ID NO: 3643 - RNA, 19 nt, Artificial Sequence
  Description of Artificial Sequence: Synthetic oligonucleotide
auccuguuuacuguaacau

SEQ ID NO: 3644 - RNA, 19 nt, Artificial Sequence
  Description of Artificial Sequence: Synthetic oligonucleotide
cauccuguuuacuguaaca

SEQ ID NO: 3645 - RNA, 19 nt, Artificial Sequence
  Description of Artificial Sequence: Synthetic oligonucleotide
ucauccuguuuacuguaac

SEQ ID NO: 3646 - RNA, 19 nt, Artificial Sequence
  Description of Artificial Sequence: Synthetic oligonucleotide
uucauccuguuuacuguaa

SEQ ID NO: 3647 - RNA, 19 nt, Artificial Sequence
  Description of Artificial Sequence: Synthetic oligonucleotide
guucauccuguuuacugua

SEQ ID NO: 3648 - RNA, 19 nt, Artificial Sequence
  Description of Artificial Sequence: Synthetic oligonucleotide
aguucauccuguuuacugu

SEQ ID NO: 3649 - RNA, 19 nt, Artificial Sequence
  Description of Artificial Sequence: Synthetic oligonucleotide
uaguucauccuguuuacug

SEQ ID NO: 3650 - RNA, 19 nt, Artificial Sequence
  Description of Artificial Sequence: Synthetic oligonucleotide
auaguucauccuguuuacu

SEQ ID NO: 3651 - RNA, 19 nt, Artificial Sequence
  Description of Artificial Sequence: Synthetic oligonucleotide
aauaguucauccuguuuac

SEQ ID NO: 3652 - RNA, 19 nt, Artificial Sequence
  Description of Artificial Sequence: Synthetic oligonucleotide
aaauaguucauccuguuua

SEQ ID NO: 3653 - RNA, 19 nt, Artificial Sequence
  Description of Artificial Sequence: Synthetic oligonucleotide
uaaauaguucauccuguuu

SEQ ID NO: 3654 - RNA, 19 nt, Artificial Sequence
  Description of Artificial Sequence: Synthetic oligonucleotide
uuaaauaguucauccuguu

SEQ ID NO: 3655 - RNA, 19 nt, Artificial Sequence
  Description of Artificial Sequence: Synthetic oligonucleotide
uuuaaauaguucauccugu

SEQ ID NO: 3656 - RNA, 19 nt, Artificial Sequence
  Description of Artificial Sequence: Synthetic oligonucleotide
guuuaaauaguucauccug

SEQ ID NO: 3657 - RNA, 19 nt, Artificial Sequence
  Description of Artificial Sequence: Synthetic oligonucleotide
gguuuaaauaguucauccu

SEQ ID NO: 3658 - RNA, 19 nt, Artificial Sequence
  Description of Artificial Sequence: Synthetic oligonucleotide
ggguuuaaauaguucaucc

SEQ ID NO: 3659 - RNA, 19 nt, Artificial Sequence
  Description of Artificial Sequence: Synthetic oligonucleotide
uggguuuaaauaguucauc

SEQ ID NO: 3660 - RNA, 19 nt, Artificial Sequence
  Description of Artificial Sequence: Synthetic oligonucleotide
guggguuuaaauaguucau

SEQ ID NO: 3661 - RNA, 19 nt, Artificial Sequence
  Description of Artificial Sequence: Synthetic oligonucleotide
aguggguuuaaauaguuca

SEQ ID NO: 3662 - RNA, 19 nt, Artificial Sequence
  Description of Artificial Sequence: Synthetic oligonucleotide
caguggguuuaaauaguuc

SEQ ID NO: 3663 - RNA, 19 nt, Artificial Sequence
  Description of Artificial Sequence: Synthetic oligonucleotide
ccaguggguuuaaauaguu

SEQ ID NO: 3664 - RNA, 19 nt, Artificial Sequence
  Description of Artificial Sequence: Synthetic oligonucleotide
cccaguggguuuaaauagu

SEQ ID NO: 3665 - RNA, 19 nt, Artificial Sequence
  Description of Artificial Sequence: Synthetic oligonucleotide
acccaguggguuuaaauag

SEQ ID NO: 3666 - RNA, 19 nt, Artificial Sequence
  Description of Artificial Sequence: Synthetic oligonucleotide
gacccaguggguuuaaaua

SEQ ID NO: 3667 - RNA, 19 nt, Artificial Sequence
  Description of Artificial Sequence: Synthetic oligonucleotide
ggacccaguggguuuaaau

SEQ ID NO: 3668 - RNA, 19 nt, Artificial Sequence
  Description of Artificial Sequence: Synthetic oligonucleotide
aggacccaguggguuuaaa

SEQ ID NO: 3669 - RNA, 19 nt, Artificial Sequence
  Description of Artificial Sequence: Synthetic oligonucleotide
caggacccaguggguuuaa

SEQ ID NO: 3670 - RNA, 19 nt, Artificial Sequence
  Description of Artificial Sequence: Synthetic oligonucleotide
gcaggacccaguggguuua

SEQ ID NO: 3671 - RNA, 19 nt, Artificial Sequence
  Description of Artificial Sequence: Synthetic oligonucleotide
ggcaggacccaguggguuu

SEQ ID NO: 3672 - RNA, 19 nt, Artificial Sequence
  Description of Artificial Sequence: Synthetic oligonucleotide
uggcaggacccaguggguu

SEQ ID NO: 3673 - RNA, 19 nt, Artificial Sequence
  Description of Artificial Sequence: Synthetic oligonucleotide
guggcaggacccagugggu

SEQ ID NO: 3674 - RNA, 19 nt, Artificial Sequence
  Description of Artificial Sequence: Synthetic oligonucleotide
uguggcaggacccaguggg

SEQ ID NO: 3675 - RNA, 19 nt, Artificial Sequence
  Description of Artificial Sequence: Synthetic oligonucleotide
auguggcaggacccagugg

SEQ ID NO: 3676 - RNA, 19 nt, Artificial Sequence
  Description of Artificial Sequence: Synthetic oligonucleotide
gauguggcaggacccagug

SEQ ID NO: 3677 - RNA, 19 nt, Artificial Sequence
  Description of Artificial Sequence: Synthetic oligonucleotide
ggauguggcaggacccagu

SEQ ID NO: 3678 - RNA, 19 nt, Artificial Sequence
  Description of Artificial Sequence: Synthetic oligonucleotide
aggauguggcaggacccag

SEQ ID NO: 3679 - RNA, 19 nt, Artificial Sequence
  Description of Artificial Sequence: Synthetic oligonucleotide
aaggauguggcaggaccca

SEQ ID NO: 3680 - RNA, 19 nt, Artificial Sequence
  Description of Artificial Sequence: Synthetic oligonucleotide
gaaggauguggcaggaccc

SEQ ID NO: 3681 - RNA, 19 nt, Artificial Sequence
  Description of Artificial Sequence: Synthetic oligonucleotide
agaaggauguggcaggacc

SEQ ID NO: 3682 - RNA, 19 nt, Artificial Sequence
  Description of Artificial Sequence: Synthetic oligonucleotide
gagaaggauguggcaggac

SEQ ID NO: 3683 - RNA, 19 nt, Artificial Sequence
  Description of Artificial Sequence: Synthetic oligonucleotide
ugagaaggauguggcagga

SEQ ID NO: 3684 - RNA, 19 nt, Artificial Sequence
  Description of Artificial Sequence: Synthetic oligonucleotide
uugagaaggauguggcagg

SEQ ID NO: 3685 - RNA, 19 nt, Artificial Sequence
  Description of Artificial Sequence: Synthetic oligonucleotide
cuugagaaggauguggcag

SEQ ID NO: 3686 - RNA, 19 nt, Artificial Sequence
  Description of Artificial Sequence: Synthetic oligonucleotide
ccuugagaaggauguggca

SEQ ID NO: 3687 - RNA, 19 nt, Artificial Sequence
  Description of Artificial Sequence: Synthetic oligonucleotide
accuugagaaggauguggc

SEQ ID NO: 3688 - RNA, 19 nt, Artificial Sequence
  Description of Artificial Sequence: Synthetic oligonucleotide
caccuugagaaggaugugg

SEQ ID NO: 3689 - RNA, 19 nt, Artificial Sequence
  Description of Artificial Sequence: Synthetic oligonucleotide
ccaccuugagaaggaugug

SEQ ID NO: 3690 - RNA, 19 nt, Artificial Sequence
  Description of Artificial Sequence: Synthetic oligonucleotide
accaccuugagaaggaugu

SEQ ID NO: 3691 - RNA, 19 nt, Artificial Sequence
  Description of Artificial Sequence: Synthetic oligonucleotide
uaccaccuugagaaggaug

SEQ ID NO: 3692 - RNA, 19 nt, Artificial Sequence
  Description of Artificial Sequence: Synthetic oligonucleotide
cuaccaccuugagaaggau

SEQ ID NO: 3693 - RNA, 19 nt, Artificial Sequence
  Description of Artificial Sequence: Synthetic oligonucleotide
ucuaccaccuugagaagga

SEQ ID NO: 3694 - RNA, 19 nt, Artificial Sequence
  Description of Artificial Sequence: Synthetic oligonucleotide
gucuaccaccuugagaagg

SEQ ID NO: 3695 - RNA, 19 nt, Artificial Sequence
  Description of Artificial Sequence: Synthetic oligonucleotide
agucuaccaccuugagaag

SEQ ID NO: 3696 - RNA, 19 nt, Artificial Sequence
  Description of Artificial Sequence: Synthetic oligonucleotide
cagucuaccaccuugagaa

SEQ ID NO: 3697 - RNA, 19 nt, Artificial Sequence
  Description of Artificial Sequence: Synthetic oligonucleotide
ucagucuaccaccuugaga

SEQ ID NO: 3698 - RNA, 19 nt, Artificial Sequence
  Description of Artificial Sequence: Synthetic oligonucleotide
cucagucuaccaccuugag

SEQ ID NO: 3699 - RNA, 19 nt, Artificial Sequence
  Description of Artificial Sequence: Synthetic oligonucleotide
acucagucuaccaccuuga

SEQ ID NO: 3700 - RNA, 19 nt, Artificial Sequence
  Description of Artificial Sequence: Synthetic oligonucleotide
cacucagucuaccaccuug

SEQ ID NO: 3701 - RNA, 19 nt, Artificial Sequence
  Description of Artificial Sequence: Synthetic oligonucleotide
ccacucagucuaccaccuu

SEQ ID NO: 3702 - RNA, 19 nt, Artificial Sequence
  Description of Artificial Sequence: Synthetic oligonucleotide
cccacucagucuaccaccu

SEQ ID NO: 3703 - RNA, 19 nt, Artificial Sequence
  Description of Artificial Sequence: Synthetic oligonucleotide
ccccacucagucuaccacc

SEQ ID NO: 3704 - RNA, 19 nt, Artificial Sequence
  Description of Artificial Sequence: Synthetic oligonucleotide
accccacucagucuaccac

SEQ ID NO: 3705 - RNA, 19 nt, Artificial Sequence
  Description of Artificial Sequence: Synthetic oligonucleotide
gaccccacucagucuacca

SEQ ID NO: 3706 - RNA, 19 nt, Artificial Sequence
  Description of Artificial Sequence: Synthetic oligonucleotide
agaccccacucagucuacc

SEQ ID NO: 3707 - RNA, 19 nt, Artificial Sequence
  Description of Artificial Sequence: Synthetic oligonucleotide
gagaccccacucagucuac

SEQ ID NO: 3708 - RNA, 19 nt, Artificial Sequence
  Description of Artificial Sequence: Synthetic oligonucleotide
agagaccccacucagucua

SEQ ID NO: 3709 - RNA, 19 nt, Artificial Sequence
  Description of Artificial Sequence: Synthetic oligonucleotide
gagagaccccacucagucu

SEQ ID NO: 3710 - RNA, 19 nt, Artificial Sequence
  Description of Artificial Sequence: Synthetic oligonucleotide
agagagaccccacucaguc

SEQ ID NO: 3711 - RNA, 19 nt, Artificial Sequence
  Description of Artificial Sequence: Synthetic oligonucleotide
cagagagaccccacucagu

SEQ ID NO: 3712 - RNA, 19 nt, Artificial Sequence
  Description of Artificial Sequence: Synthetic oligonucleotide
gcagagagaccccacucag

SEQ ID NO: 3713 - RNA, 19 nt, Artificial Sequence
  Description of Artificial Sequence: Synthetic oligonucleotide
ggcagagagaccccacuca

SEQ ID NO: 3714 - RNA, 19 nt, Artificial Sequence
  Description of Artificial Sequence: Synthetic oligonucleotide
gggcagagagaccccacuc

SEQ ID NO: 3715 - RNA, 19 nt, Artificial Sequence
  Description of Artificial Sequence: Synthetic oligonucleotide
ugggcagagagaccccacu

SEQ ID NO: 3716 - RNA, 19 nt, Artificial Sequence
  Description of Artificial Sequence: Synthetic oligonucleotide
uugggcagagagaccccac

SEQ ID NO: 3717 - RNA, 19 nt, Artificial Sequence
  Description of Artificial Sequence: Synthetic oligonucleotide
cuugggcagagagacccca

SEQ ID NO: 3718 - RNA, 19 nt, Artificial Sequence
  Description of Artificial Sequence: Synthetic oligonucleotide
ucuugggcagagagacccc

SEQ ID NO: 3719 - RNA, 19 nt, Artificial Sequence
  Description of Artificial Sequence: Synthetic oligonucleotide
aucuugggcagagagaccc

SEQ ID NO: 3720 - RNA, 19 nt, Artificial Sequence
  Description of Artificial Sequence: Synthetic oligonucleotide
gaucuugggcagagagacc

SEQ ID NO: 3721 - RNA, 19 nt, Artificial Sequence
  Description of Artificial Sequence: Synthetic oligonucleotide
ggaucuugggcagagagac

SEQ ID NO: 3722 - RNA, 19 nt, Artificial Sequence
  Description of Artificial Sequence: Synthetic oligonucleotide
gggaucuugggcagagaga

SEQ ID NO: 3723 - RNA, 19 nt, Artificial Sequence
  Description of Artificial Sequence: Synthetic oligonucleotide
agggaucuugggcagagag

SEQ ID NO: 3724 - RNA, 19 nt, Artificial Sequence
  Description of Artificial Sequence: Synthetic oligonucleotide
cagggaucuugggcagaga

SEQ ID NO: 3725 - RNA, 19 nt, Artificial Sequence
  Description of Artificial Sequence: Synthetic oligonucleotide
ucagggaucuugggcagag

SEQ ID NO: 3726 - RNA, 19 nt, Artificial Sequence
  Description of Artificial Sequence: Synthetic oligonucleotide
gucagggaucuugggcaga

SEQ ID NO: 3727 - RNA, 19 nt, Artificial Sequence
  Description of Artificial Sequence: Synthetic oligonucleotide
ugucagggaucuugggcag

SEQ ID NO: 3728 - RNA, 19 nt, Artificial Sequence
  Description of Artificial Sequence: Synthetic oligonucleotide
augucagggaucuugggca

SEQ ID NO: 3729 - RNA, 19 nt, Artificial Sequence
  Description of Artificial Sequence: Synthetic oligonucleotide
uaugucagggaucuugggc

SEQ ID NO: 3730 - RNA, 19 nt, Artificial Sequence
  Description of Artificial Sequence: Synthetic oligonucleotide
cuaugucagggaucuuggg

SEQ ID NO: 3731 - RNA, 19 nt, Artificial Sequence
  Description of Artificial Sequence: Synthetic oligonucleotide
gcuaugucagggaucuugg

SEQ ID NO: 3732 - RNA, 19 nt, Artificial Sequence
  Description of Artificial Sequence: Synthetic oligonucleotide
ugcuaugucagggaucuug

SEQ ID NO: 3733 - RNA, 19 nt, Artificial Sequence
  Description of Artificial Sequence: Synthetic oligonucleotide
cugcuaugucagggaucuu

SEQ ID NO: 3734 - RNA, 19 nt, Artificial Sequence
  Description of Artificial Sequence: Synthetic oligonucleotide
acugcuaugucagggaucu

SEQ ID NO: 3735 - RNA, 19 nt, Artificial Sequence
  Description of Artificial Sequence: Synthetic oligonucleotide
uacugcuaugucagggauc

SEQ ID NO: 3736 - RNA, 19 nt, Artificial Sequence
  Description of Artificial Sequence: Synthetic oligonucleotide
cuacugcuaugucagggau

SEQ ID NO: 3737 - RNA, 19 nt, Artificial Sequence
  Description of Artificial Sequence: Synthetic oligonucleotide
gcuacugcuaugucaggga

SEQ ID NO: 3738 - RNA, 19 nt, Artificial Sequence
  Description of Artificial Sequence: Synthetic oligonucleotide
agcuacugcuaugucaggg

SEQ ID NO: 3739 - RNA, 19 nt, Artificial Sequence
  Description of Artificial Sequence: Synthetic oligonucleotide
aagcuacugcuaugucagg

SEQ ID NO: 3740 - RNA, 19 nt, Artificial Sequence
  Description of Artificial Sequence: Synthetic oligonucleotide
caagcuacugcuaugucag

SEQ ID NO: 3741 - RNA, 19 nt, Artificial Sequence
  Description of Artificial Sequence: Synthetic oligonucleotide
acaagcuacugcuauguca

SEQ ID NO: 3742 - RNA, 19 nt, Artificial Sequence
  Description of Artificial Sequence: Synthetic oligonucleotide
gacaagcuacugcuauguc

SEQ ID NO: 3743 - RNA, 19 nt, Artificial Sequence
  Description of Artificial Sequence: Synthetic oligonucleotide
agacaagcuacugcuaugu

SEQ ID NO: 3744 - RNA, 19 nt, Artificial Sequence
  Description of Artificial Sequence: Synthetic oligonucleotide
aagacaagcuacugcuaug

SEQ ID NO: 3745 - RNA, 19 nt, Artificial Sequence
  Description of Artificial Sequence: Synthetic oligonucleotide
aaagacaagcuacugcuau

SEQ ID NO: 3746 - RNA, 19 nt, Artificial Sequence
  Description of Artificial Sequence: Synthetic oligonucleotide
aaaagacaagcuacugcua

SEQ ID NO: 3747 - RNA, 19 nt, Artificial Sequence
  Description of Artificial Sequence: Synthetic oligonucleotide
gaaaagacaagcuacugcu

SEQ ID NO: 3748 - RNA, 19 nt, Artificial Sequence
  Description of Artificial Sequence: Synthetic oligonucleotide
ggaaaagacaagcuacugc

SEQ ID NO: 3749 - RNA, 19 nt, Artificial Sequence
  Description of Artificial Sequence: Synthetic oligonucleotide
uggaaaagacaagcuacug

SEQ ID NO: 3750 - RNA, 19 nt, Artificial Sequence
  Description of Artificial Sequence: Synthetic oligonucleotide
guggaaaagacaagcuacu

SEQ ID NO: 3751 - RNA, 19 nt, Artificial Sequence
  Description of Artificial Sequence: Synthetic oligonucleotide
uguggaaaagacaagcuac

SEQ ID NO: 3752 - RNA, 19 nt, Artificial Sequence
  Description of Artificial Sequence: Synthetic oligonucleotide
auguggaaaagacaagcua

SEQ ID NO: 3753 - RNA, 19 nt, Artificial Sequence
  Description of Artificial Sequence: Synthetic oligonucleotide
cauguggaaaagacaagcu

SEQ ID NO: 3754 - RNA, 19 nt, Artificial Sequence
  Description of Artificial Sequence: Synthetic oligonucleotide
ucauguggaaaagacaagc

SEQ ID NO: 3755 - RNA, 19 nt, Artificial Sequence
  Description of Artificial Sequence: Synthetic oligonucleotide
aucauguggaaaagacaag

SEQ ID NO: 3756 - RNA, 19 nt, Artificial Sequence
  Description of Artificial Sequence: Synthetic oligonucleotide
aaucauguggaaaagacaa

SEQ ID NO: 3757 - RNA, 19 nt, Artificial Sequence
  Description of Artificial Sequence: Synthetic oligonucleotide
aaaucauguggaaaagaca

SEQ ID NO: 3758 - RNA, 19 nt, Artificial Sequence
  Description of Artificial Sequence: Synthetic oligonucleotide
caaaucauguggaaaagac

SEQ ID NO: 3759 - RNA, 19 nt, Artificial Sequence
  Description of Artificial Sequence: Synthetic oligonucleotide
acaaaucauguggaaaaga

SEQ ID NO: 3760 - RNA, 19 nt, Artificial Sequence
  Description of Artificial Sequence: Synthetic oligonucleotide
gacaaaucauguggaaaag

SEQ ID NO: 3761 - RNA, 19 nt, Artificial Sequence
  Description of Artificial Sequence: Synthetic oligonucleotide
agacaaaucauguggaaaa

SEQ ID NO: 3762 - RNA, 19 nt, Artificial Sequence
  Description of Artificial Sequence: Synthetic oligonucleotide
cagacaaaucauguggaaa

SEQ ID NO: 3763 - RNA, 19 nt, Artificial Sequence
  Description of Artificial Sequence: Synthetic oligonucleotide
acagacaaaucauguggaa

SEQ ID NO: 3764 - RNA, 19 nt, Artificial Sequence
  Description of Artificial Sequence: Synthetic oligonucleotide
cacagacaaaucaugugga

SEQ ID NO: 3765 - RNA, 19 nt, Artificial Sequence
  Description of Artificial Sequence: Synthetic oligonucleotide
ucacagacaaaucaugugg

SEQ ID NO: 3766 - RNA, 19 nt, Artificial Sequence
  Description of Artificial Sequence: Synthetic oligonucleotide
uucacagacaaaucaugug

SEQ ID NO: 3767 - RNA, 19 nt, Artificial Sequence
  Description of Artificial Sequence: Synthetic oligonucleotide
uuucacagacaaaucaugu

SEQ ID NO: 3768 - RNA, 19 nt, Artificial Sequence
  Description of Artificial Sequence: Synthetic oligonucleotide
cuuucacagacaaaucaug

SEQ ID NO: 3769 - RNA, 19 nt, Artificial Sequence
  Description of Artificial Sequence: Synthetic oligonucleotide
ucuuucacagacaaaucau

SEQ ID NO: 3770 - RNA, 19 nt, Artificial Sequence
  Description of Artificial Sequence: Synthetic oligonucleotide
uucuuucacagacaaauca

SEQ ID NO: 3771 - RNA, 19 nt, Artificial Sequence
  Description of Artificial Sequence: Synthetic oligonucleotide
uuucuuucacagacaaauc

SEQ ID NO: 3772 - RNA, 19 nt, Artificial Sequence
  Description of Artificial Sequence: Synthetic oligonucleotide
uuuucuuucacagacaaau

SEQ ID NO: 3773 - RNA, 19 nt, Artificial Sequence
  Description of Artificial Sequence: Synthetic oligonucleotide
auuuucuuucacagacaaa

SEQ ID NO: 3774 - RNA, 19 nt, Artificial Sequence
  Description of Artificial Sequence: Synthetic oligonucleotide
uauuuucuuucacagacaa

SEQ ID NO: 3775 - RNA, 19 nt, Artificial Sequence
  Description of Artificial Sequence: Synthetic oligonucleotide
uuauuuucuuucacagaca

SEQ ID NO: 3776 - RNA, 19 nt, Artificial Sequence
  Description of Artificial Sequence: Synthetic oligonucleotide
auuauuuucuuucacagac

SEQ ID NO: 3777 - RNA, 19 nt, Artificial Sequence
  Description of Artificial Sequence: Synthetic oligonucleotide
aauuauuuucuuucacaga

SEQ ID NO: 3778 - RNA, 19 nt, Artificial Sequence
  Description of Artificial Sequence: Synthetic oligonucleotide
aaauuauuuucuuucacag

SEQ ID NO: 3779 - RNA, 19 nt, Artificial Sequence
  Description of Artificial Sequence: Synthetic oligonucleotide
aaaauuauuuucuuucaca

SEQ ID NO: 3780 - RNA, 19 nt, Artificial Sequence
  Description of Artificial Sequence: Synthetic oligonucleotide
caaaauuauuuucuuucac

SEQ ID NO: 3781 - RNA, 19 nt, Artificial Sequence
  Description of Artificial Sequence: Synthetic oligonucleotide
ucaaaauuauuuucuuuca

SEQ ID NO: 3782 - RNA, 19 nt, Artificial Sequence
  Description of Artificial Sequence: Synthetic oligonucleotide
cucaaaauuauuuucuuuc

SEQ ID NO: 3783 - RNA, 19 nt, Artificial Sequence
  Description of Artificial Sequence: Synthetic oligonucleotide
ucucaaaauuauuuucuuu

SEQ ID NO: 3784 - RNA, 19 nt, Artificial Sequence
  Description of Artificial Sequence: Synthetic oligonucleotide
aucucaaaauuauuuucuu

SEQ ID NO: 3785 - RNA, 19 nt, Artificial Sequence
  Description of Artificial Sequence: Synthetic oligonucleotide
gaucucaaaauuauuuucu

SEQ ID NO: 3786 - RNA, 19 nt, Artificial Sequence
  Description of Artificial Sequence: Synthetic oligonucleotide
cgaucucaaaauuauuuuc

SEQ ID NO: 3787 - RNA, 19 nt, Artificial Sequence
  Description of Artificial Sequence: Synthetic oligonucleotide
acgaucucaaaauuauuuu

SEQ ID NO: 3788 - RNA, 19 nt, Artificial Sequence
  Description of Artificial Sequence: Synthetic oligonucleotide
aacgaucucaaaauuauuu

SEQ ID NO: 3789 - RNA, 19 nt, Artificial Sequence
  Description of Artificial Sequence: Synthetic oligonucleotide
aaacgaucucaaaauuauu

SEQ ID NO: 3790 - RNA, 19 nt, Artificial Sequence
  Description of Artificial Sequence: Synthetic oligonucleotide
aaaacgaucucaaaauuau

SEQ ID NO: 3791 - RNA, 19 nt, Artificial Sequence
  Description of Artificial Sequence: Synthetic oligonucleotide
uaaaacgaucucaaaauua

SEQ ID NO: 3792 - RNA, 19 nt, Artificial Sequence
  Description of Artificial Sequence: Synthetic oligonucleotide
auaaaacgaucucaaaauu

SEQ ID NO: 3793 - RNA, 19 nt, Artificial Sequence
  Description of Artificial Sequence: Synthetic oligonucleotide
gauaaaacgaucucaaaau

SEQ ID NO: 3794 - RNA, 19 nt, Artificial Sequence
  Description of Artificial Sequence: Synthetic oligonucleotide
agauaaaacgaucucaaaa

SEQ ID NO: 3795 - RNA, 19 nt, Artificial Sequence
  Description of Artificial Sequence: Synthetic oligonucleotide
uagauaaaacgaucucaaa

SEQ ID NO: 3796 - RNA, 19 nt, Artificial Sequence
  Description of Artificial Sequence: Synthetic oligonucleotide
auagauaaaacgaucucaa

SEQ ID NO: 3797 - RNA, 19 nt, Artificial Sequence
  Description of Artificial Sequence: Synthetic oligonucleotide
aauagauaaaacgaucuca

SEQ ID NO: 3798 - RNA, 19 nt, Artificial Sequence
  Description of Artificial Sequence: Synthetic oligonucleotide
aaauagauaaaacgaucuc

SEQ ID NO: 3799 - RNA, 19 nt, Artificial Sequence
  Description of Artificial Sequence: Synthetic oligonucleotide
aaaauagauaaaacgaucu

SEQ ID NO: 3800 - RNA, 19 nt, Artificial Sequence
  Description of Artificial Sequence: Synthetic oligonucleotide
gaaaauagauaaaacgauc

SEQ ID NO: 3801 - RNA, 19 nt, Artificial Sequence
  Description of Artificial Sequence: Synthetic oligonucleotide
agaaaauagauaaaacgau

SEQ ID NO: 3802 - RNA, 19 nt, Artificial Sequence
  Description of Artificial Sequence: Synthetic oligonucleotide
gagaaaauagauaaaacga

SEQ ID NO: 3803 - RNA, 19 nt, Artificial Sequence
  Description of Artificial Sequence: Synthetic oligonucleotide
agagaaaauagauaaaacg

SEQ ID NO: 3804 - RNA, 19 nt, Artificial Sequence
  Description of Artificial Sequence: Synthetic oligonucleotide
uagagaaaauagauaaaac

SEQ ID NO: 3805 - RNA, 19 nt, Artificial Sequence
  Description of Artificial Sequence: Synthetic oligonucleotide
guagagaaaauagauaaaa

SEQ ID NO: 3806 - RNA, 19 nt, Artificial Sequence
  Description of Artificial Sequence: Synthetic oligonucleotide
cguagagaaaauagauaaa

SEQ ID NO: 3807 - RNA, 19 nt, Artificial Sequence
  Description of Artificial Sequence: Synthetic oligonucleotide
ccguagagaaaauagauaa

SEQ ID NO: 3808 - RNA, 19 nt, Artificial Sequence
  Description of Artificial Sequence: Synthetic oligonucleotide
gccguagagaaaauagaua

SEQ ID NO: 3809 - RNA, 19 nt, Artificial Sequence
  Description of Artificial Sequence: Synthetic oligonucleotide
agccguagagaaaauagau

SEQ ID NO: 3810 - RNA, 19 nt, Artificial Sequence
  Description of Artificial Sequence: Synthetic oligonucleotide
aagccguagagaaaauaga

SEQ ID NO: 3811 - RNA, 19 nt, Artificial Sequence
  Description of Artificial Sequence: Synthetic oligonucleotide
uaagccguagagaaaauag

SEQ ID NO: 3812 - RNA, 19 nt, Artificial Sequence
  Description of Artificial Sequence: Synthetic oligonucleotide
cuaagccguagagaaaaua

SEQ ID NO: 3813 - RNA, 19 nt, Artificial Sequence
  Description of Artificial Sequence: Synthetic oligonucleotide
ccuaagccguagagaaaau

SEQ ID NO: 3814 - RNA, 19 nt, Artificial Sequence
  Description of Artificial Sequence: Synthetic oligonucleotide
gccuaagccguagagaaaa

SEQ ID NO: 3815 - RNA, 19 nt, Artificial Sequence
  Description of Artificial Sequence: Synthetic oligonucleotide
agccuaagccguagagaaa

SEQ ID NO: 3816 - RNA, 19 nt, Artificial Sequence
  Description of Artificial Sequence: Synthetic oligonucleotide
uagccuaagccguagagaa

SEQ ID NO: 3817 - RNA, 19 nt, Artificial Sequence
  Description of Artificial Sequence: Synthetic oligonucleotide
auagccuaagccguagaga

SEQ ID NO: 3818 - RNA, 19 nt, Artificial Sequence
  Description of Artificial Sequence: Synthetic oligonucleotide
cauagccuaagccguagag

SEQ ID NO: 3819 - RNA, 19 nt, Artificial Sequence
  Description of Artificial Sequence: Synthetic oligonucleotide
acauagccuaagccguaga

SEQ ID NO: 3820 - RNA, 19 nt, Artificial Sequence
  Description of Artificial Sequence: Synthetic oligonucleotide
cacauagccuaagccguag

SEQ ID NO: 3821 - RNA, 19 nt, Artificial Sequence
  Description of Artificial Sequence: Synthetic oligonucleotide
ucacauagccuaagccgua

SEQ ID NO: 3822 - RNA, 19 nt, Artificial Sequence
  Description of Artificial Sequence: Synthetic oligonucleotide
cucacauagccuaagccgu

SEQ ID NO: 3823 - RNA, 19 nt, Artificial Sequence
  Description of Artificial Sequence: Synthetic oligonucleotide
ccucacauagccuaagccg

SEQ ID NO: 3824 - RNA, 19 nt, Artificial Sequence
  Description of Artificial Sequence: Synthetic oligonucleotide
cccucacauagccuaagcc

SEQ ID NO: 3825 - RNA, 19 nt, Artificial Sequence
  Description of Artificial Sequence: Synthetic oligonucleotide
gcccucacauagccuaagc

SEQ ID NO: 3826 - RNA, 19 nt, Artificial Sequence
  Description of Artificial Sequence: Synthetic oligonucleotide
ugcccucacauagccuaag

SEQ ID NO: 3827 - RNA, 19 nt, Artificial Sequence
  Description of Artificial Sequence: Synthetic oligonucleotide
uugcccucacauagccuaa

SEQ ID NO: 3828 - RNA, 19 nt, Artificial Sequence
  Description of Artificial Sequence: Synthetic oligonucleotide
uuugcccucacauagccua

SEQ ID NO: 3829 - RNA, 19 nt, Artificial Sequence
  Description of Artificial Sequence: Synthetic oligonucleotide
uuuugcccucacauagccu

SEQ ID NO: 3830 - RNA, 19 nt, Artificial Sequence
  Description of Artificial Sequence: Synthetic oligonucleotide
guuuugcccucacauagcc

SEQ ID NO: 3831 - RNA, 19 nt, Artificial Sequence
  Description of Artificial Sequence: Synthetic oligonucleotide
uguuuugcccucacauagc

SEQ ID NO: 3832 - RNA, 19 nt, Artificial Sequence
  Description of Artificial Sequence: Synthetic oligonucleotide
guguuuugcccucacauag

SEQ ID NO: 3833 - RNA, 19 nt, Artificial Sequence
  Description of Artificial Sequence: Synthetic oligonucleotide
uguguuuugcccucacaua

SEQ ID NO: 3834 - RNA, 19 nt, Artificial Sequence
  Description of Artificial Sequence: Synthetic oligonucleotide
uuguguuuugcccucacau

SEQ ID NO: 3835 - RNA, 19 nt, Artificial Sequence
  Description of Artificial Sequence: Synthetic oligonucleotide
uuuguguuuugcccucaca

SEQ ID NO: 3836 - RNA, 19 nt, Artificial Sequence
  Description of Artificial Sequence: Synthetic oligonucleotide
auuuguguuuugcccucac

SEQ ID NO: 3837 - RNA, 19 nt, Artificial Sequence
  Description of Artificial Sequence: Synthetic oligonucleotide
gauuuguguuuugcccuca

SEQ ID NO: 3838 - RNA, 19 nt, Artificial Sequence
  Description of Artificial Sequence: Synthetic oligonucleotide
ggauuuguguuuugcccuc

SEQ ID NO: 3839 - RNA, 19 nt, Artificial Sequence
  Description of Artificial Sequence: Synthetic oligonucleotide
gggauuuguguuuugcccu

SEQ ID NO: 3840 - RNA, 19 nt, Artificial Sequence
  Description of Artificial Sequence: Synthetic oligonucleotide
agggauuuguguuuugccc

SEQ ID NO: 3841 - RNA, 19 nt, Artificial Sequence
  Description of Artificial Sequence: Synthetic oligonucleotide
aagggauuuguguuuugcc

SEQ ID NO: 3842 - RNA, 19 nt, Artificial Sequence
  Description of Artificial Sequence: Synthetic oligonucleotide
aaagggauuuguguuuugc

SEQ ID NO: 3843 - RNA, 19 nt, Artificial Sequence
  Description of Artificial Sequence: Synthetic oligonucleotide
caaagggauuuguguuuug

SEQ ID NO: 3844 - RNA, 19 nt, Artificial Sequence
  Description of Artificial Sequence: Synthetic oligonucleotide
gcaaagggauuuguguuuu

SEQ ID NO: 3845 - RNA, 19 nt, Artificial Sequence
  Description of Artificial Sequence: Synthetic oligonucleotide
agcaaagggauuuguguuu

SEQ ID NO: 3846 - RNA, 19 nt, Artificial Sequence
  Description of Artificial Sequence: Synthetic oligonucleotide
uagcaaagggauuuguguu

SEQ ID NO: 3847 - RNA, 19 nt, Artificial Sequence
  Description of Artificial Sequence: Synthetic oligonucleotide
uuagcaaagggauuugugu

SEQ ID NO: 3848 - RNA, 19 nt, Artificial Sequence
  Description of Artificial Sequence: Synthetic oligonucleotide
uuuagcaaagggauuugug

SEQ ID NO: 3849 - RNA, 19 nt, Artificial Sequence
  Description of Artificial Sequence: Synthetic oligonucleotide
uuuuagcaaagggauuugu

SEQ ID NO: 3850 - RNA, 19 nt, Artificial Sequence
  Description of Artificial Sequence: Synthetic oligonucleotide
uuuuuagcaaagggauuug

SEQ ID NO: 3851 - RNA, 19 nt, Artificial Sequence
  Description of Artificial Sequence: Synthetic oligonucleotide
cuuuuuagcaaagggauuu

SEQ ID NO: 3852 - RNA, 19 nt, Artificial Sequence
  Description of Artificial Sequence: Synthetic oligonucleotide
ucuuuuuagcaaagggauu

SEQ ID NO: 3853 - RNA, 19 nt, Artificial Sequence
  Description of Artificial Sequence: Synthetic oligonucleotide
uucuuuuuagcaaagggau

SEQ ID NO: 3854 - RNA, 19 nt, Artificial Sequence
  Description of Artificial Sequence: Synthetic oligonucleotide
guucuuuuuagcaaaggga

SEQ ID NO: 3855 - RNA, 19 nt, Artificial Sequence
  Description of Artificial Sequence: Synthetic oligonucleotide
gguucuuuuuagcaaaggg

SEQ ID NO: 3856 - RNA, 19 nt, Artificial Sequence
  Description of Artificial Sequence: Synthetic oligonucleotide
ugguucuuuuuagcaaagg

SEQ ID NO: 3857 - RNA, 19 nt, Artificial Sequence
  Description of Artificial Sequence: Synthetic oligonucleotide
augguucuuuuuagcaaag

SEQ ID NO: 3858 - RNA, 19 nt, Artificial Sequence
  Description of Artificial Sequence: Synthetic oligonucleotide
uaugguucuuuuuagcaaa

SEQ ID NO: 3859 - RNA, 19 nt, Artificial Sequence
  Description of Artificial Sequence: Synthetic oligonucleotide
auaugguucuuuuuagcaa

SEQ ID NO: 3860 - RNA, 19 nt, Artificial Sequence
  Description of Artificial Sequence: Synthetic oligonucleotide
aauaugguucuuuuuagca

SEQ ID NO: 3861 - RNA, 19 nt, Artificial Sequence
  Description of Artificial Sequence: Synthetic oligonucleotide
uaauaugguucuuuuuagc

SEQ ID NO: 3862 - RNA, 19 nt, Artificial Sequence
  Description of Artificial Sequence: Synthetic oligonucleotide
auaauaugguucuuuuuag

SEQ ID NO: 3863 - RNA, 19 nt, Artificial Sequence
  Description of Artificial Sequence: Synthetic oligonucleotide
aauaauaugguucuuuuua

SEQ ID NO: 3864 - RNA, 19 nt, Artificial Sequence
  Description of Artificial Sequence: Synthetic oligonucleotide
aaauaauaugguucuuuuu

SEQ ID NO: 3865 - RNA, 19 nt, Artificial Sequence
  Description of Artificial Sequence: Synthetic oligonucleotide
aaaauaauaugguucuuuu

SEQ ID NO: 3866 - RNA, 19 nt, Artificial Sequence
  Description of Artificial Sequence: Synthetic oligonucleotide
caaaauaauaugguucuuu

SEQ ID NO: 3867 - RNA, 19 nt, Artificial Sequence
  Description of Artificial Sequence: Synthetic oligonucleotide
ucaaaauaauaugguucuu

SEQ ID NO: 3868 - RNA, 19 nt, Artificial Sequence
  Description of Artificial Sequence: Synthetic oligonucleotide
aucaaaauaauaugguucu

SEQ ID NO: 3869 - RNA, 19 nt, Artificial Sequence
  Description of Artificial Sequence: Synthetic oligonucleotide
aaucaaaauaauaugguuc

SEQ ID NO: 3870 - RNA, 19 nt, Artificial Sequence
  Description of Artificial Sequence: Synthetic oligonucleotide
gaaucaaaauaauaugguu

SEQ ID NO: 3871 - RNA, 19 nt, Artificial Sequence
  Description of Artificial Sequence: Synthetic oligonucleotide
agaaucaaaauaauauggu

SEQ ID NO: 3872 - RNA, 19 nt, Artificial Sequence
  Description of Artificial Sequence: Synthetic oligonucleotide
gagaaucaaaauaauaugg

SEQ ID NO: 3873 - RNA, 19 nt, Artificial Sequence
  Description of Artificial Sequence: Synthetic oligonucleotide
ugagaaucaaaauaauaug

SEQ ID NO: 3874 - RNA, 19 nt, Artificial Sequence
  Description of Artificial Sequence: Synthetic oligonucleotide
uugagaaucaaaauaauau

SEQ ID NO: 3875 - RNA, 19 nt, Artificial Sequence
  Description of Artificial Sequence: Synthetic oligonucleotide
uuugagaaucaaaauaaua

SEQ ID NO: 3876 - RNA, 19 nt, Artificial Sequence
  Description of Artificial Sequence: Synthetic oligonucleotide
cuuugagaaucaaaauaau

SEQ ID NO: 3877 - RNA, 19 nt, Artificial Sequence
  Description of Artificial Sequence: Synthetic oligonucleotide
ccuuugagaaucaaaauaa

SEQ ID NO: 3878 - RNA, 19 nt, Artificial Sequence
  Description of Artificial Sequence: Synthetic oligonucleotide
uccuuugagaaucaaaaua

SEQ ID NO: 3879 - RNA, 19 nt, Artificial Sequence
  Description of Artificial Sequence: Synthetic oligonucleotide
auccuuugagaaucaaaau

SEQ ID NO: 3880 - RNA, 19 nt, Artificial Sequence
  Description of Artificial Sequence: Synthetic oligonucleotide
uauccuuugagaaucaaaa

SEQ ID NO: 3881 - RNA, 19 nt, Artificial Sequence
  Description of Artificial Sequence: Synthetic oligonucleotide
cuauccuuugagaaucaaa

SEQ ID NO: 3882 - RNA, 19 nt, Artificial Sequence
  Description of Artificial Sequence: Synthetic oligonucleotide
ccuauccuuugagaaucaa

SEQ ID NO: 3883 - RNA, 19 nt, Artificial Sequence
  Description of Artificial Sequence: Synthetic oligonucleotide
gccuauccuuugagaauca

SEQ ID NO: 3884 - RNA, 19 nt, Artificial Sequence
  Description of Artificial Sequence: Synthetic oligonucleotide
ggccuauccuuugagaauc

SEQ ID NO: 3885 - RNA, 19 nt, Artificial Sequence
  Description of Artificial Sequence: Synthetic oligonucleotide
aggccuauccuuugagaau

SEQ ID NO: 3886 - RNA, 19 nt, Artificial Sequence
  Description of Artificial Sequence: Synthetic oligonucleotide
aaggccuauccuuugagaa

SEQ ID NO: 3887 - RNA, 19 nt, Artificial Sequence
  Description of Artificial Sequence: Synthetic oligonucleotide
aaaggccuauccuuugaga

SEQ ID NO: 3888 - RNA, 19 nt, Artificial Sequence
  Description of Artificial Sequence: Synthetic oligonucleotide
caaaggccuauccuuugag

SEQ ID NO: 3889 - RNA, 19 nt, Artificial Sequence
  Description of Artificial Sequence: Synthetic oligonucleotide
ucaaaggccuauccuuuga

SEQ ID NO: 3890 - RNA, 19 nt, Artificial Sequence
  Description of Artificial Sequence: Synthetic oligonucleotide
cucaaaggccuauccuuug

SEQ ID NO: 3891 - RNA, 19 nt, Artificial Sequence
  Description of Artificial Sequence: Synthetic oligonucleotide
acucaaaggccuauccuuu

SEQ ID NO: 3892 - RNA, 19 nt, Artificial Sequence
  Description of Artificial Sequence: Synthetic oligonucleotide
cacucaaaggccuauccuu

SEQ ID NO: 3893 - RNA, 19 nt, Artificial Sequence
  Description of Artificial Sequence: Synthetic oligonucleotide
acacucaaaggccuauccu

SEQ ID NO: 3894 - RNA, 19 nt, Artificial Sequence
  Description of Artificial Sequence: Synthetic oligonucleotide
aacacucaaaggccuaucc

SEQ ID NO: 3895 - RNA, 19 nt, Artificial Sequence
  Description of Artificial Sequence: Synthetic oligonucleotide
uaacacucaaaggccuauc

SEQ ID NO: 3896 - RNA, 19 nt, Artificial Sequence
  Description of Artificial Sequence: Synthetic oligonucleotide
cuaacacucaaaggccuau

SEQ ID NO: 3897 - RNA, 19 nt, Artificial Sequence
  Description of Artificial Sequence: Synthetic oligonucleotide
ucuaacacucaaaggccua

SEQ ID NO: 3898 - RNA, 19 nt, Artificial Sequence
  Description of Artificial Sequence: Synthetic oligonucleotide
cucuaacacucaaaggccu

SEQ ID NO: 3899 - RNA, 19 nt, Artificial Sequence
  Description of Artificial Sequence: Synthetic oligonucleotide
ucucuaacacucaaaggcc

SEQ ID NO: 3900 - RNA, 19 nt, Artificial Sequence
  Description of Artificial Sequence: Synthetic oligonucleotide
uucucuaacacucaaaggc

SEQ ID NO: 3901 - RNA, 19 nt, Artificial Sequence
  Description of Artificial Sequence: Synthetic oligonucleotide
uuucucuaacacucaaagg

SEQ ID NO: 3902 - RNA, 19 nt, Artificial Sequence
  Description of Artificial Sequence: Synthetic oligonucleotide
cuuucucuaacacucaaag

SEQ ID NO: 3903 - RNA, 19 nt, Artificial Sequence
  Description of Artificial Sequence: Synthetic oligonucleotide
ccuuucucuaacacucaaa

SEQ ID NO: 3904 - RNA, 19 nt, Artificial Sequence
  Description of Artificial Sequence: Synthetic oligonucleotide
uccuuucucuaacacucaa

SEQ ID NO: 3905 - RNA, 19 nt, Artificial Sequence
  Description of Artificial Sequence: Synthetic oligonucleotide
cuccuuucucuaacacuca

SEQ ID NO: 3906 - RNA, 19 nt, Artificial Sequence
  Description of Artificial Sequence: Synthetic oligonucleotide
acuccuuucucuaacacuc

SEQ ID NO: 3907 - RNA, 19 nt, Artificial Sequence
  Description of Artificial Sequence: Synthetic oligonucleotide
cacuccuuucucuaacacu

SEQ ID NO: 3908 - RNA, 19 nt, Artificial Sequence
  Description of Artificial Sequence: Synthetic oligonucleotide
ucacuccuuucucuaacac

SEQ ID NO: 3909 - RNA, 19 nt, Artificial Sequence
  Description of Artificial Sequence: Synthetic oligonucleotide
uucacuccuuucucuaaca

SEQ ID NO: 3910 - RNA, 19 nt, Artificial Sequence
  Description of Artificial Sequence: Synthetic oligonucleotide
cuucacuccuuucucuaac

SEQ ID NO: 3911 - RNA, 19 nt, Artificial Sequence
  Description of Artificial Sequence: Synthetic oligonucleotide
ccuucacuccuuucucuaa

SEQ ID NO: 3912 - RNA, 19 nt, Artificial Sequence
  Description of Artificial Sequence: Synthetic oligonucleotide
uccuucacuccuuucucua

SEQ ID NO: 3913 - RNA, 19 nt, Artificial Sequence
  Description of Artificial Sequence: Synthetic oligonucleotide
cuccuucacuccuuucucu

SEQ ID NO: 3914 - RNA, 19 nt, Artificial Sequence
  Description of Artificial Sequence: Synthetic oligonucleotide
ccuccuucacuccuuucuc

SEQ ID NO: 3915 - RNA, 19 nt, Artificial Sequence
  Description of Artificial Sequence: Synthetic oligonucleotide
gccuccuucacuccuuucu

SEQ ID NO: 3916 - RNA, 19 nt, Artificial Sequence
  Description of Artificial Sequence: Synthetic oligonucleotide
ugccuccuucacuccuuuc

SEQ ID NO: 3917 - RNA, 19 nt, Artificial Sequence
  Description of Artificial Sequence: Synthetic oligonucleotide
cugccuccuucacuccuuu

SEQ ID NO: 3918 - RNA, 19 nt, Artificial Sequence
  Description of Artificial Sequence: Synthetic oligonucleotide
ccugccuccuucacuccuu

SEQ ID NO: 3919 - RNA, 19 nt, Artificial Sequence
  Description of Artificial Sequence: Synthetic oligonucleotide
accugccuccuucacuccu

SEQ ID NO: 3920 - RNA, 19 nt, Artificial Sequence
  Description of Artificial Sequence: Synthetic oligonucleotide
caccugccuccuucacucc

SEQ ID NO: 3921 - RNA, 19 nt, Artificial Sequence
  Description of Artificial Sequence: Synthetic oligonucleotide
ccaccugccuccuucacuc

SEQ ID NO: 3922 - RNA, 19 nt, Artificial Sequence
  Description of Artificial Sequence: Synthetic oligonucleotide
cccaccugccuccuucacu

SEQ ID NO: 3923 - RNA, 19 nt, Artificial Sequence
  Description of Artificial Sequence: Synthetic oligonucleotide
ucccaccugccuccuucac

SEQ ID NO: 3924 - RNA, 19 nt, Artificial Sequence
  Description of Artificial Sequence: Synthetic oligonucleotide
uucccaccugccuccuuca

SEQ ID NO: 3925 - RNA, 19 nt, Artificial Sequence
  Description of Artificial Sequence: Synthetic oligonucleotide
uuucccaccugccuccuuc

SEQ ID NO: 3926 - RNA, 19 nt, Artificial Sequence
  Description of Artificial Sequence: Synthetic oligonucleotide
auuucccaccugccuccuu

SEQ ID NO: 3927 - RNA, 19 nt, Artificial Sequence
  Description of Artificial Sequence: Synthetic oligonucleotide
cauuucccaccugccuccu

SEQ ID NO: 3928 - RNA, 19 nt, Artificial Sequence
  Description of Artificial Sequence: Synthetic oligonucleotide
ccauuucccaccugccucc

SEQ ID NO: 3929 - RNA, 19 nt, Artificial Sequence
  Description of Artificial Sequence: Synthetic oligonucleotide
accauuucccaccugccuc

SEQ ID NO: 3930 - RNA, 19 nt, Artificial Sequence
  Description of Artificial Sequence: Synthetic oligonucleotide
uaccauuucccaccugccu

SEQ ID NO: 3931 - RNA, 19 nt, Artificial Sequence
  Description of Artificial Sequence: Synthetic oligonucleotide
auaccauuucccaccugcc

SEQ ID NO: 3932 - RNA, 19 nt, Artificial Sequence
  Description of Artificial Sequence: Synthetic oligonucleotide
aauaccauuucccaccugc

SEQ ID NO: 3933 - RNA, 19 nt, Artificial Sequence
  Description of Artificial Sequence: Synthetic oligonucleotide
aaauaccauuucccaccug

SEQ ID NO: 3934 - RNA, 19 nt, Artificial Sequence
  Description of Artificial Sequence: Synthetic oligonucleotide
gaaauaccauuucccaccu

SEQ ID NO: 3935 - RNA, 19 nt, Artificial Sequence
  Description of Artificial Sequence: Synthetic oligonucleotide
agaaauaccauuucccacc

SEQ ID NO: 3936 - RNA, 19 nt, Artificial Sequence
  Description of Artificial Sequence: Synthetic oligonucleotide
uagaaauaccauuucccac

SEQ ID NO: 3937 - RNA, 19 nt, Artificial Sequence
  Description of Artificial Sequence: Synthetic oligonucleotide
auagaaauaccauuuccca

SEQ ID NO: 3938 - RNA, 19 nt, Artificial Sequence
  Description of Artificial Sequence: Synthetic oligonucleotide
aauagaaauaccauuuccc

SEQ ID NO: 3939 - RNA, 19 nt, Artificial Sequence
  Description of Artificial Sequence: Synthetic oligonucleotide
aaauagaaauaccauuucc

SEQ ID NO: 3940 - RNA, 19 nt, Artificial Sequence
  Description of Artificial Sequence: Synthetic oligonucleotide
aaaauagaaauaccauuuc

SEQ ID NO: 3941 - RNA, 19 nt, Artificial Sequence
  Description of Artificial Sequence: Synthetic oligonucleotide
aaaaauagaaauaccauuu

SEQ ID NO: 3942 - RNA, 19 nt, Artificial Sequence
  Description of Artificial Sequence: Synthetic oligonucleotide
uaaaaauagaaauaccauu

SEQ ID NO: 3943 - RNA, 19 nt, Artificial Sequence
  Description of Artificial Sequence: Synthetic oligonucleotide
uuaaaaauagaaauaccau

SEQ ID NO: 3944 - RNA, 19 nt, Artificial Sequence
  Description of Artificial Sequence: Synthetic oligonucleotide
uuuaaaaauagaaauacca

SEQ ID NO: 3945 - RNA, 19 nt, Artificial Sequence
  Description of Artificial Sequence: Synthetic oligonucleotide
auuuaaaaauagaaauacc

SEQ ID NO: 3946 - RNA, 19 nt, Artificial Sequence
  Description of Artificial Sequence: Synthetic oligonucleotide
gauuuaaaaauagaaauac

SEQ ID NO: 3947 - RNA, 19 nt, Artificial Sequence
  Description of Artificial Sequence: Synthetic oligonucleotide
ggauuuaaaaauagaaaua

SEQ ID NO: 3948 - RNA, 19 nt, Artificial Sequence
  Description of Artificial Sequence: Synthetic oligonucleotide
uggauuuaaaaauagaaau

SEQ ID NO: 3949 - RNA, 19 nt, Artificial Sequence
  Description of Artificial Sequence: Synthetic oligonucleotide
cuggauuuaaaaauagaaa

SEQ ID NO: 3950 - RNA, 19 nt, Artificial Sequence
  Description of Artificial Sequence: Synthetic oligonucleotide
acuggauuuaaaaauagaa

SEQ ID NO: 3951 - RNA, 19 nt, Artificial Sequence
  Description of Artificial Sequence: Synthetic oligonucleotide
cacuggauuuaaaaauaga

SEQ ID NO: 3952 - RNA, 19 nt, Artificial Sequence
  Description of Artificial Sequence: Synthetic oligonucleotide
ucacuggauuuaaaaauag

SEQ ID NO: 3953 - RNA, 19 nt, Artificial Sequence
  Description of Artificial Sequence: Synthetic oligonucleotide
uucacuggauuuaaaaaua

SEQ ID NO: 3954 - RNA, 19 nt, Artificial Sequence
  Description of Artificial Sequence: Synthetic oligonucleotide
uuucacuggauuuaaaaau

SEQ ID NO: 3955 - RNA, 19 nt, Artificial Sequence
  Description of Artificial Sequence: Synthetic oligonucleotide
auuucacuggauuuaaaaa

SEQ ID NO: 3956 - RNA, 19 nt, Artificial Sequence
  Description of Artificial Sequence: Synthetic oligonucleotide
aauuucacuggauuuaaaa

SEQ ID NO: 3957 - RNA, 19 nt, Artificial Sequence
  Description of Artificial Sequence: Synthetic oligonucleotide
uaauuucacuggauuuaaa

SEQ ID NO: 3958 - RNA, 19 nt, Artificial Sequence
  Description of Artificial Sequence: Synthetic oligonucleotide
auaauuucacuggauuuaa

SEQ ID NO: 3959 - RNA, 19 nt, Artificial Sequence
  Description of Artificial Sequence: Synthetic oligonucleotide
gauaauuucacuggauuua

SEQ ID NO: 3960 - RNA, 19 nt, Artificial Sequence
  Description of Artificial Sequence: Synthetic oligonucleotide
agauaauuucacuggauuu

SEQ ID NO: 3961 - RNA, 19 nt, Artificial Sequence
  Description of Artificial Sequence: Synthetic oligonucleotide
aagauaauuucacuggauu

SEQ ID NO: 3962 - RNA, 19 nt, Artificial Sequence
  Description of Artificial Sequence: Synthetic oligonucleotide
caagauaauuucacuggau

SEQ ID NO: 3963 - RNA, 19 nt, Artificial Sequence
  Description of Artificial Sequence: Synthetic oligonucleotide
ucaagauaauuucacugga

SEQ ID NO: 3964 - RNA, 19 nt, Artificial Sequence
  Description of Artificial Sequence: Synthetic oligonucleotide
cucaagauaauuucacugg

SEQ ID NO: 3965 - RNA, 19 nt, Artificial Sequence
  Description of Artificial Sequence: Synthetic oligonucleotide
acucaagauaauuucacug

SEQ ID NO: 3966 - RNA, 19 nt, Artificial Sequence
  Description of Artificial Sequence: Synthetic oligonucleotide
gacucaagauaauuucacu

SEQ ID NO: 3967 - RNA, 19 nt, Artificial Sequence
  Description of Artificial Sequence: Synthetic oligonucleotide
agacucaagauaauuucac

SEQ ID NO: 3968 - RNA, 19 nt, Artificial Sequence
  Description of Artificial Sequence: Synthetic oligonucleotide
uagacucaagauaauuuca

SEQ ID NO: 3969 - RNA, 19 nt, Artificial Sequence
  Description of Artificial Sequence: Synthetic oligonucleotide
guagacucaagauaauuuc

SEQ ID NO: 3970 - RNA, 19 nt, Artificial Sequence
  Description of Artificial Sequence: Synthetic oligonucleotide
uguagacucaagauaauuu

SEQ ID NO: 3971 - RNA, 19 nt, Artificial Sequence
  Description of Artificial Sequence: Synthetic oligonucleotide
guguagacucaagauaauu

SEQ ID NO: 3972 - RNA, 19 nt, Artificial Sequence
  Description of Artificial Sequence: Synthetic oligonucleotide
uguguagacucaagauaau

SEQ ID NO: 3973 - RNA, 19 nt, Artificial Sequence
  Description of Artificial Sequence: Synthetic oligonucleotide
auguguagacucaagauaa

SEQ ID NO: 3974 - RNA, 19 nt, Artificial Sequence
  Description of Artificial Sequence: Synthetic oligonucleotide
aauguguagacucaagaua

SEQ ID NO: 3975 - RNA, 19 nt, Artificial Sequence
  Description of Artificial Sequence: Synthetic oligonucleotide
uaauguguagacucaagau

SEQ ID NO: 3976 - RNA, 19 nt, Artificial Sequence
  Description of Artificial Sequence: Synthetic oligonucleotide
auaauguguagacucaaga

SEQ ID NO: 3977 - RNA, 19 nt, Artificial Sequence
  Description of Artificial Sequence: Synthetic oligonucleotide
aauaauguguagacucaag

SEQ ID NO: 3978 - RNA, 19 nt, Artificial Sequence
  Description of Artificial Sequence: Synthetic oligonucleotide
aaauaauguguagacucaa

SEQ ID NO: 3979 - RNA, 19 nt, Artificial Sequence
  Description of Artificial Sequence: Synthetic oligonucleotide
aaaauaauguguagacuca

SEQ ID NO: 3980 - RNA, 19 nt, Artificial Sequence
  Description of Artificial Sequence: Synthetic oligonucleotide
aaaaauaauguguagacuc

SEQ ID NO: 3981 - RNA, 19 nt, Artificial Sequence
  Description of Artificial Sequence: Synthetic oligonucleotide
uaaaaauaauguguagacu

SEQ ID NO: 3982 - RNA, 19 nt, Artificial Sequence
  Description of Artificial Sequence: Synthetic oligonucleotide
uuaaaaauaauguguagac

SEQ ID NO: 3983 - RNA, 19 nt, Artificial Sequence
  Description of Artificial Sequence: Synthetic oligonucleotide
uuuaaaaauaauguguaga

SEQ ID NO: 3984 - RNA, 19 nt, Artificial Sequence
  Description of Artificial Sequence: Synthetic oligonucleotide
uuuuaaaaauaauguguag

SEQ ID NO: 3985 - RNA, 19 nt, Artificial Sequence
  Description of Artificial Sequence: Synthetic oligonucleotide
guuuuaaaaauaaugugua

SEQ ID NO: 3986 - RNA, 19 nt, Artificial Sequence
  Description of Artificial Sequence: Synthetic oligonucleotide
uguuuuaaaaauaaugugu

SEQ ID NO: 3987 - RNA, 19 nt, Artificial Sequence
  Description of Artificial Sequence: Synthetic oligonucleotide
guguuuuaaaaauaaugug

SEQ ID NO: 3988 - RNA, 19 nt, Artificial Sequence
  Description of Artificial Sequence: Synthetic oligonucleotide
uguguuuuaaaaauaaugu

SEQ ID NO: 3989 - RNA, 19 nt, Artificial Sequence
  Description of Artificial Sequence: Synthetic oligonucleotide
uuguguuuuaaaaauaaug

SEQ ID NO: 3990 - RNA, 19 nt, Artificial Sequence
  Description of Artificial Sequence: Synthetic oligonucleotide
uuuguguuuuaaaaauaau

SEQ ID NO: 3991 - RNA, 19 nt, Artificial Sequence
  Description of Artificial Sequence: Synthetic oligonucleotide
uuuuguguuuuaaaaauaa

SEQ ID NO: 3992 - RNA, 19 nt, Artificial Sequence
  Description of Artificial Sequence: Synthetic oligonucleotide
uuuuuguguuuuaaaaaua

SEQ ID NO: 3993 - RNA, 19 nt, Artificial Sequence
  Description of Artificial Sequence: Synthetic oligonucleotide
auuuuuguguuuuaaaaau

SEQ ID NO: 3994 - RNA, 19 nt, Artificial Sequence
  Description of Artificial Sequence: Synthetic oligonucleotide
aauuuuuguguuuuaaaaa

SEQ ID NO: 3995 - RNA, 19 nt, Artificial Sequence
  Description of Artificial Sequence: Synthetic oligonucleotide
caauuuuuguguuuuaaaa

SEQ ID NO: 3996 - RNA, 19 nt, Artificial Sequence
  Description of Artificial Sequence: Synthetic oligonucleotide
acaauuuuuguguuuuaaa

SEQ ID NO: 3997 - RNA, 19 nt, Artificial Sequence
  Description of Artificial Sequence: Synthetic oligonucleotide
aacaauuuuuguguuuuaa

SEQ ID NO: 3998 - RNA, 19 nt, Artificial Sequence
  Description of Artificial Sequence: Synthetic oligonucleotide
gaacaauuuuuguguuuua

SEQ ID NO: 3999 - RNA, 19 nt, Artificial Sequence
  Description of Artificial Sequence: Synthetic oligonucleotide
cgaacaauuuuuguguuuu

SEQ ID NO: 4000 - RNA, 19 nt, Artificial Sequence
  Description of Artificial Sequence: Synthetic oligonucleotide
ccgaacaauuuuuguguuu

SEQ ID NO: 4001 - RNA, 19 nt, Artificial Sequence
  Description of Artificial Sequence: Synthetic oligonucleotide
gccgaacaauuuuuguguu

SEQ ID NO: 4002 - RNA, 19 nt, Artificial Sequence
  Description of Artificial Sequence: Synthetic oligonucleotide
agccgaacaauuuuugugu

SEQ ID NO: 4003 - RNA, 19 nt, Artificial Sequence
  Description of Artificial Sequence: Synthetic oligonucleotide
cagccgaacaauuuuugug

SEQ ID NO: 4004 - RNA, 19 nt, Artificial Sequence
  Description of Artificial Sequence: Synthetic oligonucleotide
ccagccgaacaauuuuugu

SEQ ID NO: 4005 - RNA, 19 nt, Artificial Sequence
  Description of Artificial Sequence: Synthetic oligonucleotide
uccagccgaacaauuuuug

SEQ ID NO: 4006 - RNA, 19 nt, Artificial Sequence
  Description of Artificial Sequence: Synthetic oligonucleotide
uuccagccgaacaauuuuu

SEQ ID NO: 4007 - RNA, 19 nt, Artificial Sequence
  Description of Artificial Sequence: Synthetic oligonucleotide
guuccagccgaacaauuuu

SEQ ID NO: 4008 - RNA, 19 nt, Artificial Sequence
  Description of Artificial Sequence: Synthetic oligonucleotide
aguuccagccgaacaauuu

SEQ ID NO: 4009 - RNA, 19 nt, Artificial Sequence
  Description of Artificial Sequence: Synthetic oligonucleotide
caguuccagccgaacaauu

SEQ ID NO: 4010 - RNA, 19 nt, Artificial Sequence
  Description of Artificial Sequence: Synthetic oligonucleotide
ucaguuccagccgaacaau

SEQ ID NO: 4011 - RNA, 19 nt, Artificial Sequence
  Description of Artificial Sequence: Synthetic oligonucleotide
gucaguuccagccgaacaa

SEQ ID NO: 4012 - RNA, 19 nt, Artificial Sequence
  Description of Artificial Sequence: Synthetic oligonucleotide
ggucaguuccagccgaaca

SEQ ID NO: 4013 - RNA, 19 nt, Artificial Sequence
  Description of Artificial Sequence: Synthetic oligonucleotide
gggucaguuccagccgaac

SEQ ID NO: 4014 - RNA, 19 nt, Artificial Sequence
  Description of Artificial Sequence: Synthetic oligonucleotide
ugggucaguuccagccgaa

SEQ ID NO: 4015 - RNA, 19 nt, Artificial Sequence
  Description of Artificial Sequence: Synthetic oligonucleotide
cugggucaguuccagccga

SEQ ID NO: 4016 - RNA, 19 nt, Artificial Sequence
  Description of Artificial Sequence: Synthetic oligonucleotide
ccugggucaguuccagccg

SEQ ID NO: 4017 - RNA, 19 nt, Artificial Sequence
  Description of Artificial Sequence: Synthetic oligonucleotide
gccugggucaguuccagcc

SEQ ID NO: 4018 - RNA, 19 nt, Artificial Sequence
  Description of Artificial Sequence: Synthetic oligonucleotide
agccugggucaguuccagc

SEQ ID NO: 4019 - RNA, 19 nt, Artificial Sequence
  Description of Artificial Sequence: Synthetic oligonucleotide
cagccugggucaguuccag

SEQ ID NO: 4020 - RNA, 19 nt, Artificial Sequence
  Description of Artificial Sequence: Synthetic oligonucleotide
ccagccugggucaguucca

SEQ ID NO: 4021 - RNA, 19 nt, Artificial Sequence
  Description of Artificial Sequence: Synthetic oligonucleotide
uccagccugggucaguucc

SEQ ID NO: 4022 - RNA, 19 nt, Artificial Sequence
  Description of Artificial Sequence: Synthetic oligonucleotide
guccagccugggucaguuc

SEQ ID NO: 4023 - RNA, 19 nt, Artificial Sequence
  Description of Artificial Sequence: Synthetic oligonucleotide
aguccagccugggucaguu

SEQ ID NO: 4024 - RNA, 19 nt, Artificial Sequence
  Description of Artificial Sequence: Synthetic oligonucleotide
aaguccagccugggucagu

SEQ ID NO: 4025 - RNA, 19 nt, Artificial Sequence
  Description of Artificial Sequence: Synthetic oligonucleotide
caaguccagccugggucag

SEQ ID NO: 4026 - RNA, 19 nt, Artificial Sequence
  Description of Artificial Sequence: Synthetic oligonucleotide
gcaaguccagccuggguca

SEQ ID NO: 4027 - RNA, 19 nt, Artificial Sequence
  Description of Artificial Sequence: Synthetic oligonucleotide
cgcaaguccagccuggguc

SEQ ID NO: 4028 - RNA, 19 nt, Artificial Sequence
  Description of Artificial Sequence: Synthetic oligonucleotide
ccgcaaguccagccugggu

SEQ ID NO: 4029 - RNA, 19 nt, Artificial Sequence
  Description of Artificial Sequence: Synthetic oligonucleotide
cccgcaaguccagccuggg

SEQ ID NO: 4030 - RNA, 19 nt, Artificial Sequence
  Description of Artificial Sequence: Synthetic oligonucleotide
ccccgcaaguccagccugg

SEQ ID NO: 4031 - RNA, 19 nt, Artificial Sequence
  Description of Artificial Sequence: Synthetic oligonucleotide
uccccgcaaguccagccug

SEQ ID NO: 4032 - RNA, 19 nt, Artificial Sequence
  Description of Artificial Sequence: Synthetic oligonucleotide
cuccccgcaaguccagccu

SEQ ID NO: 4033 - RNA, 19 nt, Artificial Sequence
  Description of Artificial Sequence: Synthetic oligonucleotide
ccuccccgcaaguccagcc

SEQ ID NO: 4034 - RNA, 19 nt, Artificial Sequence
  Description of Artificial Sequence: Synthetic oligonucleotide
uccuccccgcaaguccagc

SEQ ID NO: 4035 - RNA, 19 nt, Artificial Sequence
  Description of Artificial Sequence: Synthetic oligonucleotide
uuccuccccgcaaguccag

SEQ ID NO: 4036 - RNA, 19 nt, Artificial Sequence
  Description of Artificial Sequence: Synthetic oligonucleotide
uuuccuccccgcaagucca

SEQ ID NO: 4037 - RNA, 19 nt, Artificial Sequence
  Description of Artificial Sequence: Synthetic oligonucleotide
guuuccuccccgcaagucc

SEQ ID NO: 4038 - RNA, 19 nt, Artificial Sequence
  Description of Artificial Sequence: Synthetic oligonucleotide
aguuuccuccccgcaaguc

SEQ ID NO: 4039 - RNA, 19 nt, Artificial Sequence
  Description of Artificial Sequence: Synthetic oligonucleotide
gaguuuccuccccgcaagu

SEQ ID NO: 4040 - RNA, 19 nt, Artificial Sequence
  Description of Artificial Sequence: Synthetic oligonucleotide
ggaguuuccuccccgcaag

SEQ ID NO: 4041 - RNA, 19 nt, Artificial Sequence
  Description of Artificial Sequence: Synthetic oligonucleotide
uggaguuuccuccccgcaa

SEQ ID NO: 4042 - RNA, 19 nt, Artificial Sequence
  Description of Artificial Sequence: Synthetic oligonucleotide
cuggaguuuccuccccgca

SEQ ID NO: 4043 - RNA, 19 nt, Artificial Sequence
  Description of Artificial Sequence: Synthetic oligonucleotide
ccuggaguuuccuccccgc

SEQ ID NO: 4044 - RNA, 19 nt, Artificial Sequence
  Description of Artificial Sequence: Synthetic oligonucleotide
cccuggaguuuccuccccg

SEQ ID NO: 4045 - RNA, 19 nt, Artificial Sequence
  Description of Artificial Sequence: Synthetic oligonucleotide
gcccuggaguuuccucccc

SEQ ID NO: 4046 - RNA, 19 nt, Artificial Sequence
  Description of Artificial Sequence: Synthetic oligonucleotide
ugcccuggaguuuccuccc

SEQ ID NO: 4047 - RNA, 19 nt, Artificial Sequence
  Description of Artificial Sequence: Synthetic oligonucleotide
gugcccuggaguuuccucc

SEQ ID NO: 4048 - RNA, 19 nt, Artificial Sequence
  Description of Artificial Sequence: Synthetic oligonucleotide
agugcccuggaguuuccuc

SEQ ID NO: 4049 - RNA, 19 nt, Artificial Sequence
  Description of Artificial Sequence: Synthetic oligonucleotide
cagugcccuggaguuuccu

SEQ ID NO: 4050 - RNA, 19 nt, Artificial Sequence
  Description of Artificial Sequence: Synthetic oligonucleotide
gcagugcccuggaguuucc

SEQ ID NO: 4051 - RNA, 19 nt, Artificial Sequence
  Description of Artificial Sequence: Synthetic oligonucleotide
ugcagugcccuggaguuuc

SEQ ID NO: 4052 - RNA, 19 nt, Artificial Sequence
  Description of Artificial Sequence: Synthetic oligonucleotide
augcagugcccuggaguuu

SEQ ID NO: 4053 - RNA, 19 nt, Artificial Sequence
  Description of Artificial Sequence: Synthetic oligonucleotide
gaugcagugcccuggaguu

SEQ ID NO: 4054 - RNA, 19 nt, Artificial Sequence
  Description of Artificial Sequence: Synthetic oligonucleotide
agaugcagugcccuggagu

SEQ ID NO: 4055 - RNA, 19 nt, Artificial Sequence
  Description of Artificial Sequence: Synthetic oligonucleotide
cagaugcagugcccuggag

SEQ ID NO: 4056 - RNA, 19 nt, Artificial Sequence
  Description of Artificial Sequence: Synthetic oligonucleotide
ccagaugcagugcccugga

SEQ ID NO: 4057 - RNA, 19 nt, Artificial Sequence
  Description of Artificial Sequence: Synthetic oligonucleotide
gccagaugcagugcccugg

SEQ ID NO: 4058 - RNA, 19 nt, Artificial Sequence
  Description of Artificial Sequence: Synthetic oligonucleotide
cgccagaugcagugcccug

SEQ ID NO: 4059 - RNA, 19 nt, Artificial Sequence
  Description of Artificial Sequence: Synthetic oligonucleotide
ucgccagaugcagugcccu

SEQ ID NO: 4060 - RNA, 19 nt, Artificial Sequence
  Description of Artificial Sequence: Synthetic oligonucleotide
aucgccagaugcagugccc

SEQ ID NO: 4061 - RNA, 19 nt, Artificial Sequence
  Description of Artificial Sequence: Synthetic oligonucleotide
gaucgccagaugcagugcc

SEQ ID NO: 4062 - RNA, 19 nt, Artificial Sequence
  Description of Artificial Sequence: Synthetic oligonucleotide
ugaucgccagaugcagugc

SEQ ID NO: 4063 - RNA, 19 nt, Artificial Sequence
  Description of Artificial Sequence: Synthetic oligonucleotide
cugaucgccagaugcagug

SEQ ID NO: 4064 - RNA, 19 nt, Artificial Sequence
  Description of Artificial Sequence: Synthetic oligonucleotide
ucugaucgccagaugcagu

SEQ ID NO: 4065 - RNA, 19 nt, Artificial Sequence
  Description of Artificial Sequence: Synthetic oligonucleotide
gucugaucgccagaugcag

SEQ ID NO: 4066 - RNA, 19 nt, Artificial Sequence
  Description of Artificial Sequence: Synthetic oligonucleotide
agucugaucgccagaugca

SEQ ID NO: 4067 - RNA, 19 nt, Artificial Sequence
  Description of Artificial Sequence: Synthetic oligonucleotide
gagucugaucgccagaugc

SEQ ID NO: 4068 - RNA, 19 nt, Artificial Sequence
  Description of Artificial Sequence: Synthetic oligonucleotide
agagucugaucgccagaug

SEQ ID NO: 4069 - RNA, 19 nt, Artificial Sequence
  Description of Artificial Sequence: Synthetic oligonucleotide
cagagucugaucgccagau

SEQ ID NO: 4070 - RNA, 19 nt, Artificial Sequence
  Description of Artificial Sequence: Synthetic oligonucleotide
ucagagucugaucgccaga

SEQ ID NO: 4071 - RNA, 19 nt, Artificial Sequence
  Description of Artificial Sequence: Synthetic oligonucleotide
cucagagucugaucgccag

SEQ ID NO: 4072 - RNA, 19 nt, Artificial Sequence
  Description of Artificial Sequence: Synthetic oligonucleotide
gcucagagucugaucgcca

SEQ ID NO: 4073 - RNA, 19 nt, Artificial Sequence
  Description of Artificial Sequence: Synthetic oligonucleotide
ugcucagagucugaucgcc

SEQ ID NO: 4074 - RNA, 19 nt, Artificial Sequence
  Description of Artificial Sequence: Synthetic oligonucleotide
gugcucagagucugaucgc

SEQ ID NO: 4075 - RNA, 19 nt, Artificial Sequence
  Description of Artificial Sequence: Synthetic oligonucleotide
agugcucagagucugaucg

SEQ ID NO: 4076 - RNA, 19 nt, Artificial Sequence
  Description of Artificial Sequence: Synthetic oligonucleotide
cagugcucagagucugauc

SEQ ID NO: 4077 - RNA, 19 nt, Artificial Sequence
  Description of Artificial Sequence: Synthetic oligonucleotide
gcagugcucagagucugau

SEQ ID NO: 4078 - RNA, 19 nt, Artificial Sequence
  Description of Artificial Sequence: Synthetic oligonucleotide
ggcagugcucagagucuga

SEQ ID NO: 4079 - RNA, 19 nt, Artificial Sequence
  Description of Artificial Sequence: Synthetic oligonucleotide
gggcagugcucagagucug

SEQ ID NO: 4080 - RNA, 19 nt, Artificial Sequence
  Description of Artificial Sequence: Synthetic oligonucleotide
ggggcagugcucagagucu

SEQ ID NO: 4081 - RNA, 19 nt, Artificial Sequence
  Description of Artificial Sequence: Synthetic oligonucleotide
aggggcagugcucagaguc

SEQ ID NO: 4082 - RNA, 19 nt, Artificial Sequence
  Description of Artificial Sequence: Synthetic oligonucleotide
caggggcagugcucagagu

SEQ ID NO: 4083 - RNA, 19 nt, Artificial Sequence
  Description of Artificial Sequence: Synthetic oligonucleotide
gcaggggcagugcucagag

SEQ ID NO: 4084 - RNA, 19 nt, Artificial Sequence
  Description of Artificial Sequence: Synthetic oligonucleotide
agcaggggcagugcucaga

SEQ ID NO: 4085 - RNA, 19 nt, Artificial Sequence
  Description of Artificial Sequence: Synthetic oligonucleotide
gagcaggggcagugcucag

SEQ ID NO: 4086 - RNA, 19 nt, Artificial Sequence
  Description of Artificial Sequence: Synthetic oligonucleotide
cgagcaggggcagugcuca

SEQ ID NO: 4087 - RNA, 19 nt, Artificial Sequence
  Description of Artificial Sequence: Synthetic oligonucleotide
gcgagcaggggcagugcuc

SEQ ID NO: 4088 - RNA, 19 nt, Artificial Sequence
  Description of Artificial Sequence: Synthetic oligonucleotide
ggcgagcaggggcagugcu

SEQ ID NO: 4089 - RNA, 19 nt, Artificial Sequence
  Description of Artificial Sequence: Synthetic oligonucleotide
aggcgagcaggggcagugc

SEQ ID NO: 4090 - RNA, 19 nt, Artificial Sequence
  Description of Artificial Sequence: Synthetic oligonucleotide
aaggcgagcaggggcagug

SEQ ID NO: 4091 - RNA, 19 nt, Artificial Sequence
  Description of Artificial Sequence: Synthetic oligonucleotide
caaggcgagcaggggcagu

SEQ ID NO: 4092 - RNA, 19 nt, Artificial Sequence
  Description of Artificial Sequence: Synthetic oligonucleotide
ccaaggcgagcaggggcag

SEQ ID NO: 4093 - RNA, 19 nt, Artificial Sequence
  Description of Artificial Sequence: Synthetic oligonucleotide
accaaggcgagcaggggca

SEQ ID NO: 4094 - RNA, 19 nt, Artificial Sequence
  Description of Artificial Sequence: Synthetic oligonucleotide
gaccaaggcgagcaggggc

SEQ ID NO: 4095 - RNA, 19 nt, Artificial Sequence
  Description of Artificial Sequence: Synthetic oligonucleotide
ugaccaaggcgagcagggg

SEQ ID NO: 4096 - RNA, 19 nt, Artificial Sequence
  Description of Artificial Sequence: Synthetic oligonucleotide
augaccaaggcgagcaggg

SEQ ID NO: 4097 - RNA, 19 nt, Artificial Sequence
  Description of Artificial Sequence: Synthetic oligonucleotide
caugaccaaggcgagcagg

SEQ ID NO: 4098 - RNA, 19 nt, Artificial Sequence
  Description of Artificial Sequence: Synthetic oligonucleotide
acaugaccaaggcgagcag

SEQ ID NO: 4099 - RNA, 19 nt, Artificial Sequence
  Description of Artificial Sequence: Synthetic oligonucleotide
uacaugaccaaggcgagca

SEQ ID NO: 4100 - RNA, 19 nt, Artificial Sequence
  Description of Artificial Sequence: Synthetic oligonucleotide
guacaugaccaaggcgagc

SEQ ID NO: 4101 - RNA, 19 nt, Artificial Sequence
  Description of Artificial Sequence: Synthetic oligonucleotide
uguacaugaccaaggcgag

SEQ ID NO: 4102 - RNA, 19 nt, Artificial Sequence
  Description of Artificial Sequence: Synthetic oligonucleotide
cuguacaugaccaaggcga

SEQ ID NO: 4103 - RNA, 19 nt, Artificial Sequence
  Description of Artificial Sequence: Synthetic oligonucleotide
gcuguacaugaccaaggcg

SEQ ID NO: 4104 - RNA, 19 nt, Artificial Sequence
  Description of Artificial Sequence: Synthetic oligonucleotide
ugcuguacaugaccaaggc

SEQ ID NO: 4105 - RNA, 19 nt, Artificial Sequence
  Description of Artificial Sequence: Synthetic oligonucleotide
gugcuguacaugaccaagg

SEQ ID NO: 4106 - RNA, 19 nt, Artificial Sequence
  Description of Artificial Sequence: Synthetic oligonucleotide
agugcuguacaugaccaag

SEQ ID NO: 4107 - RNA, 19 nt, Artificial Sequence
  Description of Artificial Sequence: Synthetic oligonucleotide
cagugcuguacaugaccaa

SEQ ID NO: 4108 - RNA, 19 nt, Artificial Sequence
  Description of Artificial Sequence: Synthetic oligonucleotide
ucagugcuguacaugacca

SEQ ID NO: 4109 - RNA, 19 nt, Artificial Sequence
  Description of Artificial Sequence: Synthetic oligonucleotide
uucagugcuguacaugacc

SEQ ID NO: 4110 - RNA, 19 nt, Artificial Sequence
  Description of Artificial Sequence: Synthetic oligonucleotide
uuucagugcuguacaugac

SEQ ID NO: 4111 - RNA, 19 nt, Artificial Sequence
  Description of Artificial Sequence: Synthetic oligonucleotide
cuuucagugcuguacauga

SEQ ID NO: 4112 - RNA, 19 nt, Artificial Sequence
  Description of Artificial Sequence: Synthetic oligonucleotide
ccuuucagugcuguacaug

SEQ ID NO: 4113 - RNA, 19 nt, Artificial Sequence
  Description of Artificial Sequence: Synthetic oligonucleotide
uccuuucagugcuguacau

SEQ ID NO: 4114 - RNA, 19 nt, Artificial Sequence
  Description of Artificial Sequence: Synthetic oligonucleotide
uuccuuucagugcuguaca

SEQ ID NO: 4115 - RNA, 19 nt, Artificial Sequence
  Description of Artificial Sequence: Synthetic oligonucleotide
auuccuuucagugcuguac

SEQ ID NO: 4116 - RNA, 19 nt, Artificial Sequence
  Description of Artificial Sequence: Synthetic oligonucleotide
cauuccuuucagugcugua

SEQ ID NO: 4117 - RNA, 19 nt, Artificial Sequence
  Description of Artificial Sequence: Synthetic oligonucleotide
ucauuccuuucagugcugu

SEQ ID NO: 4118 - RNA, 19 nt, Artificial Sequence
  Description of Artificial Sequence: Synthetic oligonucleotide
uucauuccuuucagugcug

SEQ ID NO: 4119 - RNA, 19 nt, Artificial Sequence
  Description of Artificial Sequence: Synthetic oligonucleotide
cuucauuccuuucagugcu

SEQ ID NO: 4120 - RNA, 19 nt, Artificial Sequence
  Description of Artificial Sequence: Synthetic oligonucleotide
gcuucauuccuuucagugc

SEQ ID NO: 4121 - RNA, 19 nt, Artificial Sequence
  Description of Artificial Sequence: Synthetic oligonucleotide
ugcuucauuccuuucagug

SEQ ID NO: 4122 - RNA, 19 nt, Artificial Sequence
  Description of Artificial Sequence: Synthetic oligonucleotide
gugcuucauuccuuucagu

SEQ ID NO: 4123 - RNA, 19 nt, Artificial Sequence
  Description of Artificial Sequence: Synthetic oligonucleotide
ggugcuucauuccuuucag

SEQ ID NO: 4124 - RNA, 19 nt, Artificial Sequence
  Description of Artificial Sequence: Synthetic oligonucleotide
uggugcuucauuccuuuca

SEQ ID NO: 4125 - RNA, 19 nt, Artificial Sequence
  Description of Artificial Sequence: Synthetic oligonucleotide
cuggugcuucauuccuuuc

SEQ ID NO: 4126 - RNA, 19 nt, Artificial Sequence
  Description of Artificial Sequence: Synthetic oligonucleotide
gcuggugcuucauuccuuu

SEQ ID NO: 4127 - RNA, 19 nt, Artificial Sequence
  Description of Artificial Sequence: Synthetic oligonucleotide
ugcuggugcuucauuccuu

SEQ ID NO: 4128 - RNA, 19 nt, Artificial Sequence
  Description of Artificial Sequence: Synthetic oligonucleotide
cugcuggugcuucauuccu

SEQ ID NO: 4129 - RNA, 19 nt, Artificial Sequence
  Description of Artificial Sequence: Synthetic oligonucleotide
ccugcuggugcuucauucc

SEQ ID NO: 4130 - RNA, 19 nt, Artificial Sequence
  Description of Artificial Sequence: Synthetic oligonucleotide
uccugcuggugcuucauuc

SEQ ID NO: 4131 - RNA, 19 nt, Artificial Sequence
  Description of Artificial Sequence: Synthetic oligonucleotide
cuccugcuggugcuucauu

SEQ ID NO: 4132 - RNA, 19 nt, Artificial Sequence
  Description of Artificial Sequence: Synthetic oligonucleotide
ccuccugcuggugcuucau

SEQ ID NO: 4133 - RNA, 19 nt, Artificial Sequence
  Description of Artificial Sequence: Synthetic oligonucleotide
accuccugcuggugcuuca

SEQ ID NO: 4134 - RNA, 19 nt, Artificial Sequence
  Description of Artificial Sequence: Synthetic oligonucleotide
caccuccugcuggugcuuc

SEQ ID NO: 4135 - RNA, 19 nt, Artificial Sequence
  Description of Artificial Sequence: Synthetic oligonucleotide
ccaccuccugcuggugcuu

SEQ ID NO: 4136 - RNA, 19 nt, Artificial Sequence
  Description of Artificial Sequence: Synthetic oligonucleotide
uccaccuccugcuggugcu

SEQ ID NO: 4137 - RNA, 19 nt, Artificial Sequence
  Description of Artificial Sequence: Synthetic oligonucleotide
guccaccuccugcuggugc

SEQ ID NO: 4138 - RNA, 19 nt, Artificial Sequence
  Description of Artificial Sequence: Synthetic oligonucleotide
uguccaccuccugcuggug

SEQ ID NO: 4139 - RNA, 19 nt, Artificial Sequence
  Description of Artificial Sequence: Synthetic oligonucleotide
cuguccaccuccugcuggu

SEQ ID NO: 4140 - RNA, 19 nt, Artificial Sequence
  Description of Artificial Sequence: Synthetic oligonucleotide
ucuguccaccuccugcugg

SEQ ID NO: 4141 - RNA, 19 nt, Artificial Sequence
  Description of Artificial Sequence: Synthetic oligonucleotide
cucuguccaccuccugcug

SEQ ID NO: 4142 - RNA, 19 nt, Artificial Sequence
  Description of Artificial Sequence: Synthetic oligonucleotide
acucuguccaccuccugcu

SEQ ID NO: 4143 - RNA, 19 nt, Artificial Sequence
  Description of Artificial Sequence: Synthetic oligonucleotide
gacucuguccaccuccugc

SEQ ID NO: 4144 - RNA, 19 nt, Artificial Sequence
  Description of Artificial Sequence: Synthetic oligonucleotide
agacucuguccaccuccug

SEQ ID NO: 4145 - RNA, 19 nt, Artificial Sequence
  Description of Artificial Sequence: Synthetic oligonucleotide
gagacucuguccaccuccu

SEQ ID NO: 4146 - RNA, 19 nt, Artificial Sequence
  Description of Artificial Sequence: Synthetic oligonucleotide
agagacucuguccaccucc

SEQ ID NO: 4147 - RNA, 19 nt, Artificial Sequence
  Description of Artificial Sequence: Synthetic oligonucleotide
gagagacucuguccaccuc

SEQ ID NO: 4148 - RNA, 19 nt, Artificial Sequence
  Description of Artificial Sequence: Synthetic oligonucleotide
ugagagacucuguccaccu

SEQ ID NO: 4149 - RNA, 19 nt, Artificial Sequence
  Description of Artificial Sequence: Synthetic oligonucleotide
augagagacucuguccacc

SEQ ID NO: 4150 - RNA, 19 nt, Artificial Sequence
  Description of Artificial Sequence: Synthetic oligonucleotide
caugagagacucuguccac

SEQ ID NO: 4151 - RNA, 19 nt, Artificial Sequence
  Description of Artificial Sequence: Synthetic oligonucleotide
ccaugagagacucugucca

SEQ ID NO: 4152 - RNA, 19 nt, Artificial Sequence
  Description of Artificial Sequence: Synthetic oligonucleotide
uccaugagagacucugucc

SEQ ID NO: 4153 - RNA, 19 nt, Artificial Sequence
  Description of Artificial Sequence: Synthetic oligonucleotide
auccaugagagacucuguc

SEQ ID NO: 4154 - RNA, 19 nt, Artificial Sequence
  Description of Artificial Sequence: Synthetic oligonucleotide
cauccaugagagacucugu

SEQ ID NO: 4155 - RNA, 19 nt, Artificial Sequence
  Description of Artificial Sequence: Synthetic oligonucleotide
gcauccaugagagacucug

SEQ ID NO: 4156 - RNA, 19 nt, Artificial Sequence
  Description of Artificial Sequence: Synthetic oligonucleotide
ggcauccaugagagacucu

SEQ ID NO: 4157 - RNA, 19 nt, Artificial Sequence
  Description of Artificial Sequence: Synthetic oligonucleotide
cggcauccaugagagacuc

SEQ ID NO: 4158 - RNA, 19 nt, Artificial Sequence
  Description of Artificial Sequence: Synthetic oligonucleotide
ccggcauccaugagagacu

SEQ ID NO: 4159 - RNA, 19 nt, Artificial Sequence
  Description of Artificial Sequence: Synthetic oligonucleotide
gccggcauccaugagagac

SEQ ID NO: 4160 - RNA, 19 nt, Artificial Sequence
  Description of Artificial Sequence: Synthetic oligonucleotide
ugccggcauccaugagaga

SEQ ID NO: 4161 - RNA, 19 nt, Artificial Sequence
  Description of Artificial Sequence: Synthetic oligonucleotide
gugccggcauccaugagag

SEQ ID NO: 4162 - RNA, 19 nt, Artificial Sequence
  Description of Artificial Sequence: Synthetic oligonucleotide
ugugccggcauccaugaga

SEQ ID NO: 4163 - RNA, 19 nt, Artificial Sequence
  Description of Artificial Sequence: Synthetic oligonucleotide
uugugccggcauccaugag

SEQ ID NO: 4164 - RNA, 19 nt, Artificial Sequence
  Description of Artificial Sequence: Synthetic oligonucleotide
uuugugccggcauccauga

SEQ ID NO: 4165 - RNA, 19 nt, Artificial Sequence
  Description of Artificial Sequence: Synthetic oligonucleotide
uuuugugccggcauccaug

SEQ ID NO: 4166 - RNA, 19 nt, Artificial Sequence
  Description of Artificial Sequence: Synthetic oligonucleotide
guuuugugccggcauccau

SEQ ID NO: 4167 - RNA, 19 nt, Artificial Sequence
  Description of Artificial Sequence: Synthetic oligonucleotide
aguuuugugccggcaucca

SEQ ID NO: 4168 - RNA, 19 nt, Artificial Sequence
  Description of Artificial Sequence: Synthetic oligonucleotide
caguuuugugccggcaucc

SEQ ID NO: 4169 - RNA, 19 nt, Artificial Sequence
  Description of Artificial Sequence: Synthetic oligonucleotide
gcaguuuugugccggcauc

SEQ ID NO: 4170 - RNA, 19 nt, Artificial Sequence
  Description of Artificial Sequence: Synthetic oligonucleotide
ggcaguuuugugccggcau

SEQ ID NO: 4171 - RNA, 19 nt, Artificial Sequence
  Description of Artificial Sequence: Synthetic oligonucleotide
aggcaguuuugugccggca

SEQ ID NO: 4172 - RNA, 19 nt, Artificial Sequence
  Description of Artificial Sequence: Synthetic oligonucleotide
aaggcaguuuugugccggc

SEQ ID NO: 4173 - RNA, 19 nt, Artificial Sequence
  Description of Artificial Sequence: Synthetic oligonucleotide
uaaggcaguuuugugccgg

SEQ ID NO: 4174 - RNA, 19 nt, Artificial Sequence
  Description of Artificial Sequence: Synthetic oligonucleotide
uuaaggcaguuuugugccg

SEQ ID NO: 4175 - RNA, 19 nt, Artificial Sequence
  Description of Artificial Sequence: Synthetic oligonucleotide
uuuaaggcaguuuugugcc

SEQ ID NO: 4176 - RNA, 19 nt, Artificial Sequence
  Description of Artificial Sequence: Synthetic oligonucleotide
uuuuaaggcaguuuugugc

SEQ ID NO: 4177 - RNA, 19 nt, Artificial Sequence
  Description of Artificial Sequence: Synthetic oligonucleotide
auuuuaaggcaguuuugug

SEQ ID NO: 4178 - RNA, 19 nt, Artificial Sequence
  Description of Artificial Sequence: Synthetic oligonucleotide
uauuuuaaggcaguuuugu

SEQ ID NO: 4179 - RNA, 19 nt, Artificial Sequence
  Description of Artificial Sequence: Synthetic oligonucleotide
auauuuuaaggcaguuuug

SEQ ID NO: 4180 - RNA, 19 nt, Artificial Sequence
  Description of Artificial Sequence: Synthetic oligonucleotide
aauauuuuaaggcaguuuu

SEQ ID NO: 4181 - RNA, 19 nt, Artificial Sequence
  Description of Artificial Sequence: Synthetic oligonucleotide
gaauauuuuaaggcaguuu

SEQ ID NO: 4182 - RNA, 19 nt, Artificial Sequence
  Description of Artificial Sequence: Synthetic oligonucleotide
ugaauauuuuaaggcaguu

SEQ ID NO: 4183 - RNA, 19 nt, Artificial Sequence
  Description of Artificial Sequence: Synthetic oligonucleotide
augaauauuuuaaggcagu

SEQ ID NO: 4184 - RNA, 19 nt, Artificial Sequence
  Description of Artificial Sequence: Synthetic oligonucleotide
uaugaauauuuuaaggcag

SEQ ID NO: 4185 - RNA, 19 nt, Artificial Sequence
  Description of Artificial Sequence: Synthetic oligonucleotide
cuaugaauauuuuaaggca

SEQ ID NO: 4186 - RNA, 19 nt, Artificial Sequence
  Description of Artificial Sequence: Synthetic oligonucleotide
acuaugaauauuuuaaggc

SEQ ID NO: 4187 - RNA, 19 nt, Artificial Sequence
  Description of Artificial Sequence: Synthetic oligonucleotide
aacuaugaauauuuuaagg

SEQ ID NO: 4188 - RNA, 19 nt, Artificial Sequence
  Description of Artificial Sequence: Synthetic oligonucleotide
uaacuaugaauauuuuaag

SEQ ID NO: 4189 - RNA, 19 nt, Artificial Sequence
  Description of Artificial Sequence: Synthetic oligonucleotide
uuaacuaugaauauuuuaa

SEQ ID NO: 4190 - RNA, 19 nt, Artificial Sequence
  Description of Artificial Sequence: Synthetic oligonucleotide
auuaacuaugaauauuuua

SEQ ID NO: 4191 - RNA, 19 nt, Artificial Sequence
  Description of Artificial Sequence: Synthetic oligonucleotide
uauuaacuaugaauauuuu

SEQ ID NO: 4192 - RNA, 19 nt, Artificial Sequence
  Description of Artificial Sequence: Synthetic oligonucleotide
guauuaacuaugaauauuu

SEQ ID NO: 4193 - RNA, 19 nt, Artificial Sequence
  Description of Artificial Sequence: Synthetic oligonucleotide
uguauuaacuaugaauauu

SEQ ID NO: 4194 - RNA, 19 nt, Artificial Sequence
  Description of Artificial Sequence: Synthetic oligonucleotide
cuguauuaacuaugaauau

SEQ ID NO: 4195 - RNA, 19 nt, Artificial Sequence
  Description of Artificial Sequence: Synthetic oligonucleotide
ccuguauuaacuaugaaua

SEQ ID NO: 4196 - RNA, 19 nt, Artificial Sequence
  Description of Artificial Sequence: Synthetic oligonucleotide
accuguauuaacuaugaau

SEQ ID NO: 4197 - RNA, 19 nt, Artificial Sequence
  Description of Artificial Sequence: Synthetic oligonucleotide
uaccuguauuaacuaugaa

SEQ ID NO: 4198 - RNA, 19 nt, Artificial Sequence
  Description of Artificial Sequence: Synthetic oligonucleotide
auaccuguauuaacuauga

SEQ ID NO: 4199 - RNA, 19 nt, Artificial Sequence
  Description of Artificial Sequence: Synthetic oligonucleotide
uauaccuguauuaacuaug

SEQ ID NO: 4200 - RNA, 19 nt, Artificial Sequence
  Description of Artificial Sequence: Synthetic oligonucleotide
auauaccuguauuaacuau

SEQ ID NO: 4201 - RNA, 19 nt, Artificial Sequence
  Description of Artificial Sequence: Synthetic oligonucleotide
gauauaccuguauuaacua

SEQ ID NO: 4202 - RNA, 19 nt, Artificial Sequence
  Description of Artificial Sequence: Synthetic oligonucleotide
agauauaccuguauuaacu

SEQ ID NO: 4203 - RNA, 19 nt, Artificial Sequence
  Description of Artificial Sequence: Synthetic oligonucleotide
uagauauaccuguauuaac

SEQ ID NO: 4204 - RNA, 19 nt, Artificial Sequence
  Description of Artificial Sequence: Synthetic oligonucleotide
auagauauaccuguauuaa

SEQ ID NO: 4205 - RNA, 19 nt, Artificial Sequence
  Description of Artificial Sequence: Synthetic oligonucleotide
aauagauauaccuguauua

SEQ ID NO: 4206 - RNA, 19 nt, Artificial Sequence
  Description of Artificial Sequence: Synthetic oligonucleotide
aaauagauauaccuguauu

SEQ ID NO: 4207 - RNA, 19 nt, Artificial Sequence
  Description of Artificial Sequence: Synthetic oligonucleotide
aaaauagauauaccuguau

SEQ ID NO: 4208 - RNA, 19 nt, Artificial Sequence
  Description of Artificial Sequence: Synthetic oligonucleotide
aaaaauagauauaccugua

SEQ ID NO: 4209 - RNA, 19 nt, Artificial Sequence
  Description of Artificial Sequence: Synthetic oligonucleotide
uaaaaauagauauaccugu

SEQ ID NO: 4210 - RNA, 19 nt, Artificial Sequence
  Description of Artificial Sequence: Synthetic oligonucleotide
auaaaaauagauauaccug

SEQ ID NO: 4211 - RNA, 19 nt, Artificial Sequence
  Description of Artificial Sequence: Synthetic oligonucleotide
aauaaaaauagauauaccu

SEQ ID NO: 4212 - RNA, 19 nt, Artificial Sequence
  Description of Artificial Sequence: Synthetic oligonucleotide
aaauaaaaauagauauacc

SEQ ID NO: 4213 - RNA, 19 nt, Artificial Sequence
  Description of Artificial Sequence: Synthetic oligonucleotide
uaaauaaaaauagauauac

SEQ ID NO: 4214 - RNA, 19 nt, Artificial Sequence
  Description of Artificial Sequence: Synthetic oligonucleotide
guaaauaaaaauagauaua

SEQ ID NO: 4215 - RNA, 19 nt, Artificial Sequence
  Description of Artificial Sequence: Synthetic oligonucleotide
aguaaauaaaaauagauau

SEQ ID NO: 4216 - RNA, 19 nt, Artificial Sequence
  Description of Artificial Sequence: Synthetic oligonucleotide
aaguaaauaaaaauagaua

SEQ ID NO: 4217 - RNA, 19 nt, Artificial Sequence
  Description of Artificial Sequence: Synthetic oligonucleotide
aaaguaaauaaaaauagau

SEQ ID NO: 4218 - RNA, 19 nt, Artificial Sequence
  Description of Artificial Sequence: Synthetic oligonucleotide
caaaguaaauaaaaauaga

SEQ ID NO: 4219 - RNA, 19 nt, Artificial Sequence
  Description of Artificial Sequence: Synthetic oligonucleotide
acaaaguaaauaaaaauag

SEQ ID NO: 4220 - RNA, 19 nt, Artificial Sequence
  Description of Artificial Sequence: Synthetic oligonucleotide
uacaaaguaaauaaaaaua

SEQ ID NO: 4221 - RNA, 19 nt, Artificial Sequence
  Description of Artificial Sequence: Synthetic oligonucleotide
uuacaaaguaaauaaaaau

SEQ ID NO: 4222 - RNA, 19 nt, Artificial Sequence
  Description of Artificial Sequence: Synthetic oligonucleotide
cuuacaaaguaaauaaaaa

SEQ ID NO: 4223 - RNA, 19 nt, Artificial Sequence
  Description of Artificial Sequence: Synthetic oligonucleotide
ucuuacaaaguaaauaaaa

SEQ ID NO: 4224 - RNA, 19 nt, Artificial Sequence
  Description of Artificial Sequence: Synthetic oligonucleotide
uucuuacaaaguaaauaaa

SEQ ID NO: 4225 - RNA, 19 nt, Artificial Sequence
  Description of Artificial Sequence: Synthetic oligonucleotide
uuucuuacaaaguaaauaa

SEQ ID NO: 4226 - RNA, 19 nt, Artificial Sequence
  Description of Artificial Sequence: Synthetic oligonucleotide
guuucuuacaaaguaaaua

SEQ ID NO: 4227 - RNA, 19 nt, Artificial Sequence
  Description of Artificial Sequence: Synthetic oligonucleotide
uguuucuuacaaaguaaau

SEQ ID NO: 4228 - RNA, 19 nt, Artificial Sequence
  Description of Artificial Sequence: Synthetic oligonucleotide
uuguuucuuacaaaguaaa

SEQ ID NO: 4229 - RNA, 19 nt, Artificial Sequence
  Description of Artificial Sequence: Synthetic oligonucleotide
cuuguuucuuacaaaguaa

SEQ ID NO: 4230 - RNA, 19 nt, Artificial Sequence
  Description of Artificial Sequence: Synthetic oligonucleotide
gcuuguuucuuacaaagua

SEQ ID NO: 4231 - RNA, 19 nt, Artificial Sequence
  Description of Artificial Sequence: Synthetic oligonucleotide
agcuuguuucuuacaaagu

SEQ ID NO: 4232 - RNA, 19 nt, Artificial Sequence
  Description of Artificial Sequence: Synthetic oligonucleotide
gagcuuguuucuuacaaag

SEQ ID NO: 4233 - RNA, 19 nt, Artificial Sequence
  Description of Artificial Sequence: Synthetic oligonucleotide
ugagcuuguuucuuacaaa

SEQ ID NO: 4234 - RNA, 19 nt, Artificial Sequence
  Description of Artificial Sequence: Synthetic oligonucleotide
uugagcuuguuucuuacaa

SEQ ID NO: 4235 - RNA, 19 nt, Artificial Sequence
  Description of Artificial Sequence: Synthetic oligonucleotide
cuugagcuuguuucuuaca

SEQ ID NO: 4236 - RNA, 19 nt, Artificial Sequence
  Description of Artificial Sequence: Synthetic oligonucleotide
ccuugagcuuguuucuuac

SEQ ID NO: 4237 - RNA, 19 nt, Artificial Sequence
  Description of Artificial Sequence: Synthetic oligonucleotide
uccuugagcuuguuucuua

SEQ ID NO: 4238 - RNA, 19 nt, Artificial Sequence
  Description of Artificial Sequence: Synthetic oligonucleotide
cuccuugagcuuguuucuu

SEQ ID NO: 4239 - RNA, 19 nt, Artificial Sequence
  Description of Artificial Sequence: Synthetic oligonucleotide
gcuccuugagcuuguuucu

SEQ ID NO: 4240 - RNA, 19 nt, Artificial Sequence
  Description of Artificial Sequence: Synthetic oligonucleotide
agcuccuugagcuuguuuc

SEQ ID NO: 4241 - RNA, 19 nt, Artificial Sequence
  Description of Artificial Sequence: Synthetic oligonucleotide
aagcuccuugagcuuguuu

SEQ ID NO: 4242 - RNA, 19 nt, Artificial Sequence
  Description of Artificial Sequence: Synthetic oligonucleotide
gaagcuccuugagcuuguu

SEQ ID NO: 4243 - RNA, 19 nt, Artificial Sequence
  Description of Artificial Sequence: Synthetic oligonucleotide
ggaagcuccuugagcuugu

SEQ ID NO: 4244 - RNA, 19 nt, Artificial Sequence
  Description of Artificial Sequence: Synthetic oligonucleotide
aggaagcuccuugagcuug

SEQ ID NO: 4245 - RNA, 19 nt, Artificial Sequence
  Description of Artificial Sequence: Synthetic oligonucleotide
aaggaagcuccuugagcuu

SEQ ID NO: 4246 - RNA, 19 nt, Artificial Sequence
  Description of Artificial Sequence: Synthetic oligonucleotide
aaaggaagcuccuugagcu

SEQ ID NO: 4247 - RNA, 19 nt, Artificial Sequence
  Description of Artificial Sequence: Synthetic oligonucleotide
aaaaggaagcuccuugagc

SEQ ID NO: 4248 - RNA, 19 nt, Artificial Sequence
  Description of Artificial Sequence: Synthetic oligonucleotide
uaaaaggaagcuccuugag

SEQ ID NO: 4249 - RNA, 19 nt, Artificial Sequence
  Description of Artificial Sequence: Synthetic oligonucleotide
uuaaaaggaagcuccuuga

SEQ ID NO: 4250 - RNA, 19 nt, Artificial Sequence
  Description of Artificial Sequence: Synthetic oligonucleotide
uuuaaaaggaagcuccuug

SEQ ID NO: 4251 - RNA, 19 nt, Artificial Sequence
  Description of Artificial Sequence: Synthetic oligonucleotide
auuuaaaaggaagcuccuu

SEQ ID NO: 4252 - RNA, 19 nt, Artificial Sequence
  Description of Artificial Sequence: Synthetic oligonucleotide
aauuuaaaaggaagcuccu

SEQ ID NO: 4253 - RNA, 19 nt, Artificial Sequence
  Description of Artificial Sequence: Synthetic oligonucleotide
aaauuuaaaaggaagcucc

SEQ ID NO: 4254 - RNA, 19 nt, Artificial Sequence
  Description of Artificial Sequence: Synthetic oligonucleotide
aaaauuuaaaaggaagcuc

SEQ ID NO: 4255 - RNA, 19 nt, Artificial Sequence
  Description of Artificial Sequence: Synthetic oligonucleotide
caaaauuuaaaaggaagcu

SEQ ID NO: 4256 - RNA, 19 nt, Artificial Sequence
  Description of Artificial Sequence: Synthetic oligonucleotide
acaaaauuuaaaaggaagc

SEQ ID NO: 4257 - RNA, 19 nt, Artificial Sequence
  Description of Artificial Sequence: Synthetic oligonucleotide
gacaaaauuuaaaaggaag

SEQ ID NO: 4258 - RNA, 19 nt, Artificial Sequence
  Description of Artificial Sequence: Synthetic oligonucleotide
agacaaaauuuaaaaggaa

SEQ ID NO: 4259 - RNA, 19 nt, Artificial Sequence
  Description of Artificial Sequence: Synthetic oligonucleotide
cagacaaaauuuaaaagga

SEQ ID NO: 4260 - RNA, 19 nt, Artificial Sequence
  Description of Artificial Sequence: Synthetic oligonucleotide
acagacaaaauuuaaaagg

SEQ ID NO: 4261 - RNA, 19 nt, Artificial Sequence
  Description of Artificial Sequence: Synthetic oligonucleotide
uacagacaaaauuuaaaag

SEQ ID NO: 4262 - RNA, 19 nt, Artificial Sequence
  Description of Artificial Sequence: Synthetic oligonucleotide
cuacagacaaaauuuaaaa

SEQ ID NO: 4263 - RNA, 19 nt, Artificial Sequence
  Description of Artificial Sequence: Synthetic oligonucleotide
ccuacagacaaaauuuaaa

SEQ ID NO: 4264 - RNA, 19 nt, Artificial Sequence
  Description of Artificial Sequence: Synthetic oligonucleotide
uccuacagacaaaauuuaa

SEQ ID NO: 4265 - RNA, 19 nt, Artificial Sequence
  Description of Artificial Sequence: Synthetic oligonucleotide
uuccuacagacaaaauuua

SEQ ID NO: 4266 - RNA, 19 nt, Artificial Sequence
  Description of Artificial Sequence: Synthetic oligonucleotide
uuuccuacagacaaaauuu

SEQ ID NO: 4267 - RNA, 19 nt, Artificial Sequence
  Description of Artificial Sequence: Synthetic oligonucleotide
auuuccuacagacaaaauu

SEQ ID NO: 4268 - RNA, 19 nt, Artificial Sequence
  Description of Artificial Sequence: Synthetic oligonucleotide
cauuuccuacagacaaaau

SEQ ID NO: 4269 - RNA, 19 nt, Artificial Sequence
  Description of Artificial Sequence: Synthetic oligonucleotide
ccauuuccuacagacaaaa

SEQ ID NO: 4270 - RNA, 19 nt, Artificial Sequence
  Description of Artificial Sequence: Synthetic oligonucleotide
accauuuccuacagacaaa

SEQ ID NO: 4271 - RNA, 19 nt, Artificial Sequence
  Description of Artificial Sequence: Synthetic oligonucleotide
aaccauuuccuacagacaa

SEQ ID NO: 4272 - RNA, 19 nt, Artificial Sequence
  Description of Artificial Sequence: Synthetic oligonucleotide
caaccauuuccuacagaca

SEQ ID NO: 4273 - RNA, 19 nt, Artificial Sequence
  Description of Artificial Sequence: Synthetic oligonucleotide
ucaaccauuuccuacagac

SEQ ID NO: 4274 - RNA, 19 nt, Artificial Sequence
  Description of Artificial Sequence: Synthetic oligonucleotide
uucaaccauuuccuacaga

SEQ ID NO: 4275 - RNA, 19 nt, Artificial Sequence
  Description of Artificial Sequence: Synthetic oligonucleotide
uuucaaccauuuccuacag

SEQ ID NO: 4276 - RNA, 19 nt, Artificial Sequence
  Description of Artificial Sequence: Synthetic oligonucleotide
uuuucaaccauuuccuaca

SEQ ID NO: 4277 - RNA, 19 nt, Artificial Sequence
  Description of Artificial Sequence: Synthetic oligonucleotide
guuuucaaccauuuccuac

SEQ ID NO: 4278 - RNA, 19 nt, Artificial Sequence
  Description of Artificial Sequence: Synthetic oligonucleotide
aguuuucaaccauuuccua

SEQ ID NO: 4279 - RNA, 19 nt, Artificial Sequence
  Description of Artificial Sequence: Synthetic oligonucleotide
caguuuucaaccauuuccu

SEQ ID NO: 4280 - RNA, 19 nt, Artificial Sequence
  Description of Artificial Sequence: Synthetic oligonucleotide
ucaguuuucaaccauuucc

SEQ ID NO: 4281 - RNA, 19 nt, Artificial Sequence
  Description of Artificial Sequence: Synthetic oligonucleotide
uucaguuuucaaccauuuc

SEQ ID NO: 4282 - RNA, 19 nt, Artificial Sequence
  Description of Artificial Sequence: Synthetic oligonucleotide
cuucaguuuucaaccauuu

SEQ ID NO: 4283 - RNA, 19 nt, Artificial Sequence
  Description of Artificial Sequence: Synthetic oligonucleotide
ccuucaguuuucaaccauu

SEQ ID NO: 4284 - RNA, 19 nt, Artificial Sequence
  Description of Artificial Sequence: Synthetic oligonucleotide
accuucaguuuucaaccau

SEQ ID NO: 4285 - RNA, 19 nt, Artificial Sequence
  Description of Artificial Sequence: Synthetic oligonucleotide
uaccuucaguuuucaacca

SEQ ID NO: 4286 - RNA, 19 nt, Artificial Sequence
  Description of Artificial Sequence: Synthetic oligonucleotide
cuaccuucaguuuucaacc

SEQ ID NO: 4287 - RNA, 19 nt, Artificial Sequence
  Description of Artificial Sequence: Synthetic oligonucleotide
ucuaccuucaguuuucaac

SEQ ID NO: 4288 - RNA, 19 nt, Artificial Sequence
  Description of Artificial Sequence: Synthetic oligonucleotide
aucuaccuucaguuuucaa

SEQ ID NO: 4289 - RNA, 19 nt, Artificial Sequence
  Description of Artificial Sequence: Synthetic oligonucleotide
caucuaccuucaguuuuca

SEQ ID NO: 4290 - RNA, 19 nt, Artificial Sequence
  Description of Artificial Sequence: Synthetic oligonucleotide
ccaucuaccuucaguuuuc

SEQ ID NO: 4291 - RNA, 19 nt, Artificial Sequence
  Description of Artificial Sequence: Synthetic oligonucleotide
accaucuaccuucaguuuu

SEQ ID NO: 4292 - RNA, 19 nt, Artificial Sequence
  Description of Artificial Sequence: Synthetic oligonucleotide
caccaucuaccuucaguuu

SEQ ID NO: 4293 - RNA, 19 nt, Artificial Sequence
  Description of Artificial Sequence: Synthetic oligonucleotide
acaccaucuaccuucaguu

SEQ ID NO: 4294 - RNA, 19 nt, Artificial Sequence
  Description of Artificial Sequence: Synthetic oligonucleotide
aacaccaucuaccuucagu

SEQ ID NO: 4295 - RNA, 19 nt, Artificial Sequence
  Description of Artificial Sequence: Synthetic oligonucleotide
uaacaccaucuaccuucag

SEQ ID NO: 4296 - RNA, 19 nt, Artificial Sequence
  Description of Artificial Sequence: Synthetic oligonucleotide
auaacaccaucuaccuuca

SEQ ID NO: 4297 - RNA, 19 nt, Artificial Sequence
  Description of Artificial Sequence: Synthetic oligonucleotide
uauaacaccaucuaccuuc

SEQ ID NO: 4298 - RNA, 19 nt, Artificial Sequence
  Description of Artificial Sequence: Synthetic oligonucleotide
cuauaacaccaucuaccuu

SEQ ID NO: 4299 - RNA, 19 nt, Artificial Sequence
  Description of Artificial Sequence: Synthetic oligonucleotide
acuauaacaccaucuaccu

SEQ ID NO: 4300 - RNA, 19 nt, Artificial Sequence
  Description of Artificial Sequence: Synthetic oligonucleotide
aacuauaacaccaucuacc

SEQ ID NO: 4301 - RNA, 19 nt, Artificial Sequence
  Description of Artificial Sequence: Synthetic oligonucleotide
uaacuauaacaccaucuac

SEQ ID NO: 4302 - RNA, 19 nt, Artificial Sequence
  Description of Artificial Sequence: Synthetic oligonucleotide
uuaacuauaacaccaucua

SEQ ID NO: 4303 - RNA, 19 nt, Artificial Sequence
  Description of Artificial Sequence: Synthetic oligonucleotide
auuaacuauaacaccaucu

SEQ ID NO: 4304 - RNA, 19 nt, Artificial Sequence
  Description of Artificial Sequence: Synthetic oligonucleotide
uauuaacuauaacaccauc

SEQ ID NO: 4305 - RNA, 19 nt, Artificial Sequence
  Description of Artificial Sequence: Synthetic oligonucleotide
uuauuaacuauaacaccau

SEQ ID NO: 4306 - RNA, 19 nt, Artificial Sequence
  Description of Artificial Sequence: Synthetic oligonucleotide
auuauuaacuauaacacca

SEQ ID NO: 4307 - RNA, 19 nt, Artificial Sequence
  Description of Artificial Sequence: Synthetic oligonucleotide
uauuauuaacuauaacacc

SEQ ID NO: 4308 - RNA, 19 nt, Artificial Sequence
  Description of Artificial Sequence: Synthetic oligonucleotide
uuauuauuaacuauaacac

SEQ ID NO: 4309 - RNA, 19 nt, Artificial Sequence
  Description of Artificial Sequence: Synthetic oligonucleotide
uuuauuauuaacuauaaca

SEQ ID NO: 4310 - RNA, 19 nt, Artificial Sequence
  Description of Artificial Sequence: Synthetic oligonucleotide
auuuauuauuaacuauaac

SEQ ID NO: 4311 - RNA, 19 nt, Artificial Sequence
  Description of Artificial Sequence: Synthetic oligonucleotide
cauuuauuauuaacuauaa

SEQ ID NO: 4312 - RNA, 19 nt, Artificial Sequence
  Description of Artificial Sequence: Synthetic oligonucleotide
gcauuuauuauuaacuaua

SEQ ID NO: 4313 - RNA, 19 nt, Artificial Sequence
  Description of Artificial Sequence: Synthetic oligonucleotide
agcauuuauuauuaacuau

SEQ ID NO: 4314 - RNA, 19 nt, Artificial Sequence
  Description of Artificial Sequence: Synthetic oligonucleotide
cagcauuuauuauuaacua

SEQ ID NO: 4315 - RNA, 19 nt, Artificial Sequence
  Description of Artificial Sequence: Synthetic oligonucleotide
acagcauuuauuauuaacu

SEQ ID NO: 4316 - RNA, 19 nt, Artificial Sequence
  Description of Artificial Sequence: Synthetic oligonucleotide
uacagcauuuauuauuaac

SEQ ID NO: 4317 - RNA, 19 nt, Artificial Sequence
  Description of Artificial Sequence: Synthetic oligonucleotide
uuacagcauuuauuauuaa

SEQ ID NO: 4318 - RNA, 19 nt, Artificial Sequence
  Description of Artificial Sequence: Synthetic oligonucleotide
uuuacagcauuuauuauua

SEQ ID NO: 4319 - RNA, 19 nt, Artificial Sequence
  Description of Artificial Sequence: Synthetic oligonucleotide
auuuacagcauuuauuauu

SEQ ID NO: 4320 - RNA, 19 nt, Artificial Sequence
  Description of Artificial Sequence: Synthetic oligonucleotide
uauuuacagcauuuauuau

SEQ ID NO: 4321 - RNA, 19 nt, Artificial Sequence
  Description of Artificial Sequence: Synthetic oligonucleotide
uuauuuacagcauuuauua

SEQ ID NO: 4322 - RNA, 19 nt, Artificial Sequence
  Description of Artificial Sequence: Synthetic oligonucleotide
cuuauuuacagcauuuauu

SEQ ID NO: 4323 - RNA, 19 nt, Artificial Sequence
  Description of Artificial Sequence: Synthetic oligonucleotide
gcuuauuuacagcauuuau

SEQ ID NO: 4324 - RNA, 19 nt, Artificial Sequence
  Description of Artificial Sequence: Synthetic oligonucleotide
ugcuuauuuacagcauuua

SEQ ID NO: 4325 - RNA, 19 nt, Artificial Sequence
  Description of Artificial Sequence: Synthetic oligonucleotide
augcuuauuuacagcauuu

SEQ ID NO: 4326 - RNA, 19 nt, Artificial Sequence
  Description of Artificial Sequence: Synthetic oligonucleotide
gaugcuuauuuacagcauu

SEQ ID NO: 4327 - RNA, 19 nt, Artificial Sequence
  Description of Artificial Sequence: Synthetic oligonucleotide
agaugcuuauuuacagcau

SEQ ID NO: 4328 - RNA, 19 nt, Artificial Sequence
  Description of Artificial Sequence: Synthetic oligonucleotide
gagaugcuuauuuacagca

SEQ ID NO: 4329 - RNA, 19 nt, Artificial Sequence
  Description of Artificial Sequence: Synthetic oligonucleotide
ugagaugcuuauuuacagc

SEQ ID NO: 4330 - RNA, 19 nt, Artificial Sequence
  Description of Artificial Sequence: Synthetic oligonucleotide
gugagaugcuuauuuacag

SEQ ID NO: 4331 - RNA, 19 nt, Artificial Sequence
  Description of Artificial Sequence: Synthetic oligonucleotide
agugagaugcuuauuuaca

SEQ ID NO: 4332 - RNA, 19 nt, Artificial Sequence
  Description of Artificial Sequence: Synthetic oligonucleotide
aagugagaugcuuauuuac

SEQ ID NO: 4333 - RNA, 19 nt, Artificial Sequence
  Description of Artificial Sequence: Synthetic oligonucleotide
aaagugagaugcuuauuua

SEQ ID NO: 4334 - RNA, 19 nt, Artificial Sequence
  Description of Artificial Sequence: Synthetic oligonucleotide
caaagugagaugcuuauuu

SEQ ID NO: 4335 - RNA, 19 nt, Artificial Sequence
  Description of Artificial Sequence: Synthetic oligonucleotide
acaaagugagaugcuuauu

SEQ ID NO: 4336 - RNA, 19 nt, Artificial Sequence
  Description of Artificial Sequence: Synthetic oligonucleotide
uacaaagugagaugcuuau

SEQ ID NO: 4337 - RNA, 19 nt, Artificial Sequence
  Description of Artificial Sequence: Synthetic oligonucleotide
uuacaaagugagaugcuua

SEQ ID NO: 4338 - RNA, 19 nt, Artificial Sequence
  Description of Artificial Sequence: Synthetic oligonucleotide
uuuacaaagugagaugcuu

SEQ ID NO: 4339 - RNA, 19 nt, Artificial Sequence
  Description of Artificial Sequence: Synthetic oligonucleotide
uuuuacaaagugagaugcu

SEQ ID NO: 4340 - RNA, 19 nt, Artificial Sequence
  Description of Artificial Sequence: Synthetic oligonucleotide
uuuuuacaaagugagaugc

SEQ ID NO: 4341 - RNA, 19 nt, Artificial Sequence
  Description of Artificial Sequence: Synthetic oligonucleotide
auuuuuacaaagugagaug

SEQ ID NO: 4342 - RNA, 19 nt, Artificial Sequence
  Description of Artificial Sequence: Synthetic oligonucleotide
uauuuuuacaaagugagau

SEQ ID NO: 4343 - RNA, 19 nt, Artificial Sequence
  Description of Artificial Sequence: Synthetic oligonucleotide
uuauuuuuacaaagugaga

SEQ ID NO: 4344 - RNA, 19 nt, Artificial Sequence
  Description of Artificial Sequence: Synthetic oligonucleotide
uuuauuuuuacaaagugag

SEQ ID NO: 4345 - RNA, 19 nt, Artificial Sequence
  Description of Artificial Sequence: Synthetic oligonucleotide
uuuuauuuuuacaaaguga

SEQ ID NO: 4346 - RNA, 19 nt, Artificial Sequence
  Description of Artificial Sequence: Synthetic oligonucleotide
auuuuauuuuuacaaagug

SEQ ID NO: 4347 - RNA, 19 nt, Artificial Sequence
  Description of Artificial Sequence: Synthetic oligonucleotide
uauuuuauuuuuacaaagu

SEQ ID NO: 4348 - RNA, 19 nt, Artificial Sequence
  Description of Artificial Sequence: Synthetic oligonucleotide
auauuuuauuuuuacaaag

SEQ ID NO: 4349 - RNA, 19 nt, Artificial Sequence
  Description of Artificial Sequence: Synthetic oligonucleotide
aauauuuuauuuuuacaaa

SEQ ID NO: 4350 - RNA, 19 nt, Artificial Sequence
  Description of Artificial Sequence: Synthetic oligonucleotide
caauauuuuauuuuuacaa

SEQ ID NO: 4351 - RNA, 19 nt, Artificial Sequence
  Description of Artificial Sequence: Synthetic oligonucleotide
acaauauuuuauuuuuaca

SEQ ID NO: 4352 - RNA, 19 nt, Artificial Sequence
  Description of Artificial Sequence: Synthetic oligonucleotide
cacaauauuuuauuuuuac

SEQ ID NO: 4353 - RNA, 19 nt, Artificial Sequence
  Description of Artificial Sequence: Synthetic oligonucleotide
ccacaauauuuuauuuuua

SEQ ID NO: 4354 - RNA, 19 nt, Artificial Sequence
  Description of Artificial Sequence: Synthetic oligonucleotide
accacaauauuuuauuuuu

SEQ ID NO: 4355 - RNA, 19 nt, Artificial Sequence
  Description of Artificial Sequence: Synthetic oligonucleotide
aaccacaauauuuuauuuu

SEQ ID NO: 4356 - RNA, 19 nt, Artificial Sequence
  Description of Artificial Sequence: Synthetic oligonucleotide
aaaccacaauauuuuauuu

SEQ ID NO: 4357 - RNA, 19 nt, Artificial Sequence
  Description of Artificial Sequence: Synthetic oligonucleotide
aaaaccacaauauuuuauu

SEQ ID NO: 4358 - RNA, 19 nt, Artificial Sequence
  Description of Artificial Sequence: Synthetic oligonucleotide
caaaaccacaauauuuuau

SEQ ID NO: 4359 - RNA, 19 nt, Artificial Sequence
  Description of Artificial Sequence: Synthetic oligonucleotide
acaaaaccacaauauuuua

SEQ ID NO: 4360 - RNA, 19 nt, Artificial Sequence
  Description of Artificial Sequence: Synthetic oligonucleotide
aacaaaaccacaauauuuu

SEQ ID NO: 4361 - RNA, 19 nt, Artificial Sequence
  Description of Artificial Sequence: Synthetic oligonucleotide
aaacaaaaccacaauauuu

SEQ ID NO: 4362 - RNA, 19 nt, Artificial Sequence
  Description of Artificial Sequence: Synthetic oligonucleotide
aaaacaaaaccacaauauu

SEQ ID NO: 4363 - RNA, 19 nt, Artificial Sequence
  Description of Artificial Sequence: Synthetic oligonucleotide
uaaaacaaaaccacaauau

SEQ ID NO: 4364 - RNA, 19 nt, Artificial Sequence
  Description of Artificial Sequence: Synthetic oligonucleotide
uuaaaacaaaaccacaaua

SEQ ID NO: 4365 - RNA, 19 nt, Artificial Sequence
  Description of Artificial Sequence: Synthetic oligonucleotide
uuuaaaacaaaaccacaau

SEQ ID NO: 4366 - RNA, 19 nt, Artificial Sequence
  Description of Artificial Sequence: Synthetic oligonucleotide
guuuaaaacaaaaccacaa

SEQ ID NO: 4367 - RNA, 19 nt, Artificial Sequence
  Description of Artificial Sequence: Synthetic oligonucleotide
uguuuaaaacaaaaccaca

SEQ ID NO: 4368 - RNA, 19 nt, Artificial Sequence
  Description of Artificial Sequence: Synthetic oligonucleotide
auguuuaaaacaaaaccac

SEQ ID NO: 4369 - RNA, 19 nt, Artificial Sequence
  Description of Artificial Sequence: Synthetic oligonucleotide
aauguuuaaaacaaaacca

SEQ ID NO: 4370 - RNA, 19 nt, Artificial Sequence
  Description of Artificial Sequence: Synthetic oligonucleotide
gaauguuuaaaacaaaacc

SEQ ID NO: 4371 - RNA, 19 nt, Artificial Sequence
  Description of Artificial Sequence: Synthetic oligonucleotide
ugaauguuuaaaacaaaac

SEQ ID NO: 4372 - RNA, 19 nt, Artificial Sequence
  Description of Artificial Sequence: Synthetic oligonucleotide
uugaauguuuaaaacaaaa

SEQ ID NO: 4373 - RNA, 19 nt, Artificial Sequence
  Description of Artificial Sequence: Synthetic oligonucleotide
guugaauguuuaaaacaaa

SEQ ID NO: 4374 - RNA, 19 nt, Artificial Sequence
  Description of Artificial Sequence: Synthetic oligonucleotide
cguugaauguuuaaaacaa

SEQ ID NO: 4375 - RNA, 19 nt, Artificial Sequence
  Description of Artificial Sequence: Synthetic oligonucleotide
acguugaauguuuaaaaca

SEQ ID NO: 4376 - RNA, 19 nt, Artificial Sequence
  Description of Artificial Sequence: Synthetic oligonucleotide
aacguugaauguuuaaaac

SEQ ID NO: 4377 - RNA, 19 nt, Artificial Sequence
  Description of Artificial Sequence: Synthetic oligonucleotide
aaacguugaauguuuaaaa

SEQ ID NO: 4378 - RNA, 19 nt, Artificial Sequence
  Description of Artificial Sequence: Synthetic oligonucleotide
gaaacguugaauguuuaaa

SEQ ID NO: 4379 - RNA, 19 nt, Artificial Sequence
  Description of Artificial Sequence: Synthetic oligonucleotide
agaaacguugaauguuuaa

SEQ ID NO: 4380 - RNA, 19 nt, Artificial Sequence
  Description of Artificial Sequence: Synthetic oligonucleotide
aagaaacguugaauguuua

SEQ ID NO: 4381 - RNA, 19 nt, Artificial Sequence
  Description of Artificial Sequence: Synthetic oligonucleotide
aaagaaacguugaauguuu

SEQ ID NO: 4382 - RNA, 19 nt, Artificial Sequence
  Description of Artificial Sequence: Synthetic oligonucleotide
aaaagaaacguugaauguu

SEQ ID NO: 4383 - RNA, 19 nt, Artificial Sequence
  Description of Artificial Sequence: Synthetic oligonucleotide
gaaaagaaacguugaaugu

SEQ ID NO: 4384 - RNA, 19 nt, Artificial Sequence
  Description of Artificial Sequence: Synthetic oligonucleotide
ggaaaagaaacguugaaug

SEQ ID NO: 4385 - RNA, 19 nt, Artificial Sequence
  Description of Artificial Sequence: Synthetic oligonucleotide
aggaaaagaaacguugaau

SEQ ID NO: 4386 - RNA, 19 nt, Artificial Sequence
  Description of Artificial Sequence: Synthetic oligonucleotide
aaggaaaagaaacguugaa

SEQ ID NO: 4387 - RNA, 19 nt, Artificial Sequence
  Description of Artificial Sequence: Synthetic oligonucleotide
gaaggaaaagaaacguuga

SEQ ID NO: 4388 - RNA, 19 nt, Artificial Sequence
  Description of Artificial Sequence: Synthetic oligonucleotide
agaaggaaaagaaacguug

SEQ ID NO: 4389 - RNA, 19 nt, Artificial Sequence
  Description of Artificial Sequence: Synthetic oligonucleotide
uagaaggaaaagaaacguu

SEQ ID NO: 4390 - RNA, 19 nt, Artificial Sequence
  Description of Artificial Sequence: Synthetic oligonucleotide
guagaaggaaaagaaacgu

SEQ ID NO: 4391 - RNA, 19 nt, Artificial Sequence
  Description of Artificial Sequence: Synthetic oligonucleotide
uguagaaggaaaagaaacg

SEQ ID NO: 4392 - RNA, 19 nt, Artificial Sequence
  Description of Artificial Sequence: Synthetic oligonucleotide
uuguagaaggaaaagaaac

SEQ ID NO: 4393 - RNA, 19 nt, Artificial Sequence
  Description of Artificial Sequence: Synthetic oligonucleotide
auuguagaaggaaaagaaa

SEQ ID NO: 4394 - RNA, 19 nt, Artificial Sequence
  Description of Artificial Sequence: Synthetic oligonucleotide
uauuguagaaggaaaagaa

SEQ ID NO: 4395 - RNA, 19 nt, Artificial Sequence
  Description of Artificial Sequence: Synthetic oligonucleotide
uuauuguagaaggaaaaga

SEQ ID NO: 4396 - RNA, 19 nt, Artificial Sequence
  Description of Artificial Sequence: Synthetic oligonucleotide
uuuauuguagaaggaaaag

SEQ ID NO: 4397 - RNA, 19 nt, Artificial Sequence
  Description of Artificial Sequence: Synthetic oligonucleotide
guuuauuguagaaggaaaa

SEQ ID NO: 4398 - RNA, 19 nt, Artificial Sequence
  Description of Artificial Sequence: Synthetic oligonucleotide
uguuuauuguagaaggaaa

SEQ ID NO: 4399 - RNA, 19 nt, Artificial Sequence
  Description of Artificial Sequence: Synthetic oligonucleotide
guguuuauuguagaaggaa

SEQ ID NO: 4400 - RNA, 19 nt, Artificial Sequence
  Description of Artificial Sequence: Synthetic oligonucleotide
aguguuuauuguagaagga

SEQ ID NO: 4401 - RNA, 19 nt, Artificial Sequence
  Description of Artificial Sequence: Synthetic oligonucleotide
aaguguuuauuguagaagg

SEQ ID NO: 4402 - RNA, 19 nt, Artificial Sequence
  Description of Artificial Sequence: Synthetic oligonucleotide
aaaguguuuauuguagaag

SEQ ID NO: 4403 - RNA, 19 nt, Artificial Sequence
  Description of Artificial Sequence: Synthetic oligonucleotide
gaaaguguuuauuguagaa

SEQ ID NO: 4404 - RNA, 19 nt, Artificial Sequence
  Description of Artificial Sequence: Synthetic oligonucleotide
ugaaaguguuuauuguaga

SEQ ID NO: 4405 - RNA, 19 nt, Artificial Sequence
  Description of Artificial Sequence: Synthetic oligonucleotide
uugaaaguguuuauuguag

SEQ ID NO: 4406 - RNA, 19 nt, Artificial Sequence
  Description of Artificial Sequence: Synthetic oligonucleotide
uuugaaaguguuuauugua

SEQ ID NO: 4407 - RNA, 19 nt, Artificial Sequence
  Description of Artificial Sequence: Synthetic oligonucleotide
uuuugaaaguguuuauugu

SEQ ID NO: 4408 - RNA, 19 nt, Artificial Sequence
  Description of Artificial Sequence: Synthetic oligonucleotide
auuuugaaaguguuuauug

SEQ ID NO: 4409 - RNA, 19 nt, Artificial Sequence
  Description of Artificial Sequence: Synthetic oligonucleotide
cauuuugaaaguguuuauu

SEQ ID NO: 4410 - RNA, 19 nt, Artificial Sequence
  Description of Artificial Sequence: Synthetic oligonucleotide
acauuuugaaaguguuuau

SEQ ID NO: 4411 - RNA, 19 nt, Artificial Sequence
  Description of Artificial Sequence: Synthetic oligonucleotide
cacauuuugaaaguguuua

SEQ ID NO: 4412 - RNA, 19 nt, Artificial Sequence
  Description of Artificial Sequence: Synthetic oligonucleotide
ucacauuuugaaaguguuu

SEQ ID NO: 4413 - DNA, 20 bp, Artificial Sequence
  Description of Artificial Sequence: Synthetic oligonucleotide
tcacattttgaaagtgttta

SEQ ID NO: 4414 - DNA, 20 bp, Artificial Sequence
  Description of Artificial Sequence: Synthetic oligonucleotide
cacattttgaaagtgtttat

SEQ ID NO: 4415 - DNA, 20 bp, Artificial Sequence
  Description of Artificial Sequence: Synthetic oligonucleotide
acattttgaaagtgtttatt

SEQ ID NO: 4416 - DNA, 20 bp, Artificial Sequence
  Description of Artificial Sequence: Synthetic oligonucleotide
cattttgaaagtgtttattg

SEQ ID NO: 4417 - DNA, 20 bp, Artificial Sequence
  Description of Artificial Sequence: Synthetic oligonucleotide
attttgaaagtgtttattgt

SEQ ID NO: 4418 - DNA, 20 bp, Artificial Sequence
  Description of Artificial Sequence: Synthetic oligonucleotide
ttttgaaagtgtttattgta

SEQ ID NO: 4419 - DNA, 20 bp, Artificial Sequence
  Description of Artificial Sequence: Synthetic oligonucleotide
tttgaaagtgtttattgtag

SEQ ID NO: 4420 - DNA, 20 bp, Artificial Sequence
  Description of Artificial Sequence: Synthetic oligonucleotide
ttgaaagtgtttattgtaga

SEQ ID NO: 4421 - DNA, 20 bp, Artificial Sequence
  Description of Artificial Sequence: Synthetic oligonucleotide
tgaaagtgtttattgtagaa

SEQ ID NO: 4422 - DNA, 20 bp, Artificial Sequence
  Description of Artificial Sequence: Synthetic oligonucleotide
gaaagtgtttattgtagaag

SEQ ID NO: 4423 - DNA, 20 bp, Artificial Sequence
  Description of Artificial Sequence: Synthetic oligonucleotide
aaagtgtttattgtagaagg

SEQ ID NO: 4424 - DNA, 20 bp, Artificial Sequence
  Description of Artificial Sequence: Synthetic oligonucleotide
aagtgtttattgtagaagga

SEQ ID NO: 4425 - DNA, 20 bp, Artificial Sequence
  Description of Artificial Sequence: Synthetic oligonucleotide
agtgtttattgtagaaggaa

SEQ ID NO: 4426 - DNA, 20 bp, Artificial Sequence
  Description of Artificial Sequence: Synthetic oligonucleotide
gtgtttattgtagaaggaaa

SEQ ID NO: 4427 - DNA, 20 bp, Artificial Sequence
  Description of Artificial Sequence: Synthetic oligonucleotide
tgtttattgtagaaggaaaa

SEQ ID NO: 4428 - DNA, 20 bp, Artificial Sequence
  Description of Artificial Sequence: Synthetic oligonucleotide
gtttattgtagaaggaaaag

SEQ ID NO: 4429 - DNA, 20 bp, Artificial Sequence
  Description of Artificial Sequence: Synthetic oligonucleotide
tttattgtagaaggaaaaga

SEQ ID NO: 4430 - DNA, 20 bp, Artificial Sequence
  Description of Artificial Sequence: Synthetic oligonucleotide
ttattgtagaaggaaaagaa

SEQ ID NO: 4431 - DNA, 20 bp, Artificial Sequence
  Description of Artificial Sequence: Synthetic oligonucleotide
tattgtagaaggaaaagaaa

SEQ ID NO: 4432 - DNA, 20 bp, Artificial Sequence
  Description of Artificial Sequence: Synthetic oligonucleotide
attgtagaaggaaaagaaac

SEQ ID NO: 4433 - DNA, 20 bp, Artificial Sequence
  Description of Artificial Sequence: Synthetic oligonucleotide
ttgtagaaggaaaagaaacg

SEQ ID NO: 4434 - DNA, 20 bp, Artificial Sequence
  Description of Artificial Sequence: Synthetic oligonucleotide
tgtagaaggaaaagaaacgt

SEQ ID NO: 4435 - DNA, 20 bp, Artificial Sequence
  Description of Artificial Sequence: Synthetic oligonucleotide
gtagaaggaaaagaaacgtt

SEQ ID NO: 4436 - DNA, 20 bp, Artificial Sequence
  Description of Artificial Sequence: Synthetic oligonucleotide
tagaaggaaaagaaacgttg

SEQ ID NO: 4437 - DNA, 20 bp, Artificial Sequence
  Description of Artificial Sequence: Synthetic oligonucleotide
agaaggaaaagaaacgttga

SEQ ID NO: 4438 - DNA, 20 bp, Artificial Sequence
  Description of Artificial Sequence: Synthetic oligonucleotide
gaaggaaaagaaacgttgaa

SEQ ID NO: 4439 - DNA, 20 bp, Artificial Sequence
  Description of Artificial Sequence: Synthetic oligonucleotide
aaggaaaagaaacgttgaat

SEQ ID NO: 4440 - DNA, 20 bp, Artificial Sequence
  Description of Artificial Sequence: Synthetic oligonucleotide
aggaaaagaaacgttgaatg

SEQ ID NO: 4441 - DNA, 20 bp, Artificial Sequence
  Description of Artificial Sequence: Synthetic oligonucleotide
ggaaaagaaacgttgaatgt

SEQ ID NO: 4442 - DNA, 20 bp, Artificial Sequence
  Description of Artificial Sequence: Synthetic oligonucleotide
gaaaagaaacgttgaatgtt

SEQ ID NO: 4443 - DNA, 20 bp, Artificial Sequence
  Description of Artificial Sequence: Synthetic oligonucleotide
aaaagaaacgttgaatgttt

SEQ ID NO: 4444 - DNA, 20 bp, Artificial Sequence
  Description of Artificial Sequence: Synthetic oligonucleotide
aaagaaacgttgaatgttta

SEQ ID NO: 4445 - DNA, 20 bp, Artificial Sequence
  Description of Artificial Sequence: Synthetic oligonucleotide
aagaaacgttgaatgtttaa

SEQ ID NO: 4446 - DNA, 20 bp, Artificial Sequence
  Description of Artificial Sequence: Synthetic oligonucleotide
agaaacgttgaatgtttaaa

SEQ ID NO: 4447 - DNA, 20 bp, Artificial Sequence
  Description of Artificial Sequence: Synthetic oligonucleotide
gaaacgttgaatgtttaaaa

SEQ ID NO: 4448 - DNA, 20 bp, Artificial Sequence
  Description of Artificial Sequence: Synthetic oligonucleotide
aaacgttgaatgtttaaaac

SEQ ID NO: 4449 - DNA, 20 bp, Artificial Sequence
  Description of Artificial Sequence: Synthetic oligonucleotide
aacgttgaatgtttaaaaca

SEQ ID NO: 4450 - DNA, 20 bp, Artificial Sequence
  Description of Artificial Sequence: Synthetic oligonucleotide
acgttgaatgtttaaaacaa

SEQ ID NO: 4451 - DNA, 20 bp, Artificial Sequence
  Description of Artificial Sequence: Synthetic oligonucleotide
cgttgaatgtttaaaacaaa

SEQ ID NO: 4452 - DNA, 20 bp, Artificial Sequence
  Description of Artificial Sequence: Synthetic oligonucleotide
gttgaatgtttaaaacaaaa

SEQ ID NO: 4453 - DNA, 20 bp, Artificial Sequence
  Description of Artificial Sequence: Synthetic oligonucleotide
ttgaatgtttaaaacaaaac

SEQ ID NO: 4454 - DNA, 20 bp, Artificial Sequence
  Description of Artificial Sequence: Synthetic oligonucleotide
tgaatgtttaaaacaaaacc

SEQ ID NO: 4455 - DNA, 20 bp, Artificial Sequence
  Description of Artificial Sequence: Synthetic oligonucleotide
gaatgtttaaaacaaaacca

SEQ ID NO: 4456 - DNA, 20 bp, Artificial Sequence
  Description of Artificial Sequence: Synthetic oligonucleotide
aatgtttaaaacaaaaccac

SEQ ID NO: 4457 - DNA, 20 bp, Artificial Sequence
  Description of Artificial Sequence: Synthetic oligonucleotide
atgtttaaaacaaaaccaca

SEQ ID NO: 4458 - DNA, 20 bp, Artificial Sequence
  Description of Artificial Sequence: Synthetic oligonucleotide
tgtttaaaacaaaaccacaa

SEQ ID NO: 4459 - DNA, 20 bp, Artificial Sequence
  Description of Artificial Sequence: Synthetic oligonucleotide
gtttaaaacaaaaccacaat

SEQ ID NO: 4460 - DNA, 20 bp, Artificial Sequence
  Description of Artificial Sequence: Synthetic oligonucleotide
tttaaaacaaaaccacaata

SEQ ID NO: 4461 - DNA, 20 bp, Artificial Sequence
  Description of Artificial Sequence: Synthetic oligonucleotide
ttaaaacaaaaccacaatat

SEQ ID NO: 4462 - DNA, 20 bp, Artificial Sequence
  Description of Artificial Sequence: Synthetic oligonucleotide
taaaacaaaaccacaatatt

SEQ ID NO: 4463 - DNA, 20 bp, Artificial Sequence
  Description of Artificial Sequence: Synthetic oligonucleotide
aaaacaaaaccacaatattt

SEQ ID NO: 4464 - DNA, 20 bp, Artificial Sequence
  Description of Artificial Sequence: Synthetic oligonucleotide
aaacaaaaccacaatatttt

SEQ ID NO: 4465 - DNA, 20 bp, Artificial Sequence
  Description of Artificial Sequence: Synthetic oligonucleotide
aacaaaaccacaatatttta

SEQ ID NO: 4466 - DNA, 20 bp, Artificial Sequence
  Description of Artificial Sequence: Synthetic oligonucleotide
acaaaaccacaatattttat

SEQ ID NO: 4467 - DNA, 20 bp, Artificial Sequence
  Description of Artificial Sequence: Synthetic oligonucleotide
caaaaccacaatattttatt

SEQ ID NO: 4468 - DNA, 20 bp, Artificial Sequence
  Description of Artificial Sequence: Synthetic oligonucleotide
aaaaccacaatattttattt

SEQ ID NO: 4469 - DNA, 20 bp, Artificial Sequence
  Description of Artificial Sequence: Synthetic oligonucleotide
aaaccacaatattttatttt

SEQ ID NO: 4470 - DNA, 20 bp, Artificial Sequence
  Description of Artificial Sequence: Synthetic oligonucleotide
aaccacaatattttattttt

SEQ ID NO: 4471 - DNA, 20 bp, Artificial Sequence
  Description of Artificial Sequence: Synthetic oligonucleotide
accacaatattttattttta

SEQ ID NO: 4472 - DNA, 20 bp, Artificial Sequence
  Description of Artificial Sequence: Synthetic oligonucleotide
ccacaatattttatttttac

SEQ ID NO: 4473 - DNA, 20 bp, Artificial Sequence
  Description of Artificial Sequence: Synthetic oligonucleotide
cacaatattttatttttaca

SEQ ID NO: 4474 - DNA, 20 bp, Artificial Sequence
  Description of Artificial Sequence: Synthetic oligonucleotide
acaatattttatttttacaa

SEQ ID NO: 4475 - DNA, 20 bp, Artificial Sequence
  Description of Artificial Sequence: Synthetic oligonucleotide
caatattttatttttacaaa

SEQ ID NO: 4476 - DNA, 20 bp, Artificial Sequence
  Description of Artificial Sequence: Synthetic oligonucleotide
aatattttatttttacaaag

SEQ ID NO: 4477 - DNA, 20 bp, Artificial Sequence
  Description of Artificial Sequence: Synthetic oligonucleotide
atattttatttttacaaagt

SEQ ID NO: 4478 - DNA, 20 bp, Artificial Sequence
  Description of Artificial Sequence: Synthetic oligonucleotide
tattttatttttacaaagtg

SEQ ID NO: 4479 - DNA, 20 bp, Artificial Sequence
  Description of Artificial Sequence: Synthetic oligonucleotide
attttatttttacaaagtga

SEQ ID NO: 4480 - DNA, 20 bp, Artificial Sequence
  Description of Artificial Sequence: Synthetic oligonucleotide
ttttatttttacaaagtgag

SEQ ID NO: 4481 - DNA, 20 bp, Artificial Sequence
  Description of Artificial Sequence: Synthetic oligonucleotide
tttatttttacaaagtgaga

SEQ ID NO: 4482 - DNA, 20 bp, Artificial Sequence
  Description of Artificial Sequence: Synthetic oligonucleotide
ttatttttacaaagtgagat

SEQ ID NO: 4483 - DNA, 20 bp, Artificial Sequence
  Description of Artificial Sequence: Synthetic oligonucleotide
tatttttacaaagtgagatg

SEQ ID NO: 4484 - DNA, 20 bp, Artificial Sequence
  Description of Artificial Sequence: Synthetic oligonucleotide
atttttacaaagtgagatgc

SEQ ID NO: 4485 - DNA, 20 bp, Artificial Sequence
  Description of Artificial Sequence: Synthetic oligonucleotide
tttttacaaagtgagatgct

SEQ ID NO: 4486 - DNA, 20 bp, Artificial Sequence
  Description of Artificial Sequence: Synthetic oligonucleotide
ttttacaaagtgagatgctt

SEQ ID NO: 4487 - DNA, 20 bp, Artificial Sequence
  Description of Artificial Sequence: Synthetic oligonucleotide
tttacaaagtgagatgctta

SEQ ID NO: 4488 - DNA, 20 bp, Artificial Sequence
  Description of Artificial Sequence: Synthetic oligonucleotide
ttacaaagtgagatgcttat

SEQ ID NO: 4489 - DNA, 20 bp, Artificial Sequence
  Description of Artificial Sequence: Synthetic oligonucleotide
tacaaagtgagatgcttatt

SEQ ID NO: 4490 - DNA, 20 bp, Artificial Sequence
  Description of Artificial Sequence: Synthetic oligonucleotide
acaaagtgagatgcttattt

SEQ ID NO: 4491 - DNA, 20 bp, Artificial Sequence
  Description of Artificial Sequence: Synthetic oligonucleotide
caaagtgagatgcttattta

SEQ ID NO: 4492 - DNA, 20 bp, Artificial Sequence
  Description of Artificial Sequence: Synthetic oligonucleotide
aaagtgagatgcttatttac

SEQ ID NO: 4493 - DNA, 20 bp, Artificial Sequence
  Description of Artificial Sequence: Synthetic oligonucleotide
aagtgagatgcttatttaca

SEQ ID NO: 4494 - DNA, 20 bp, Artificial Sequence
  Description of Artificial Sequence: Synthetic oligonucleotide
agtgagatgcttatttacag

SEQ ID NO: 4495 - DNA, 20 bp, Artificial Sequence
  Description of Artificial Sequence: Synthetic oligonucleotide
gtgagatgcttatttacagc

SEQ ID NO: 4496 - DNA, 20 bp, Artificial Sequence
  Description of Artificial Sequence: Synthetic oligonucleotide
tgagatgcttatttacagca

SEQ ID NO: 4497 - DNA, 20 bp, Artificial Sequence
  Description of Artificial Sequence: Synthetic oligonucleotide
gagatgcttatttacagcat

SEQ ID NO: 4498 - DNA, 20 bp, Artificial Sequence
  Description of Artificial Sequence: Synthetic oligonucleotide
agatgcttatttacagcatt

SEQ ID NO: 4499 - DNA, 20 bp, Artificial Sequence
  Description of Artificial Sequence: Synthetic oligonucleotide
gatgcttatttacagcattt

SEQ ID NO: 4500 - DNA, 20 bp, Artificial Sequence
  Description of Artificial Sequence: Synthetic oligonucleotide
atgcttatttacagcattta

SEQ ID NO: 4501 - DNA, 20 bp, Artificial Sequence
  Description of Artificial Sequence: Synthetic oligonucleotide
tgcttatttacagcatttat

SEQ ID NO: 4502 - DNA, 20 bp, Artificial Sequence
  Description of Artificial Sequence: Synthetic oligonucleotide
gcttatttacagcatttatt

SEQ ID NO: 4503 - DNA, 20 bp, Artificial Sequence
  Description of Artificial Sequence: Synthetic oligonucleotide
cttatttacagcatttatta

SEQ ID NO: 4504 - DNA, 20 bp, Artificial Sequence
  Description of Artificial Sequence: Synthetic oligonucleotide
ttatttacagcatttattat

SEQ ID NO: 4505 - DNA, 20 bp, Artificial Sequence
  Description of Artificial Sequence: Synthetic oligonucleotide
tatttacagcatttattatt

SEQ ID NO: 4506 - DNA, 20 bp, Artificial Sequence
  Description of Artificial Sequence: Synthetic oligonucleotide
atttacagcatttattatta

SEQ ID NO: 4507 - DNA, 20 bp, Artificial Sequence
  Description of Artificial Sequence: Synthetic oligonucleotide
tttacagcatttattattaa

SEQ ID NO: 4508 - DNA, 20 bp, Artificial Sequence
  Description of Artificial Sequence: Synthetic oligonucleotide
ttacagcatttattattaac

SEQ ID NO: 4509 - DNA, 20 bp, Artificial Sequence
  Description of Artificial Sequence: Synthetic oligonucleotide
tacagcatttattattaact

SEQ ID NO: 4510 - DNA, 20 bp, Artificial Sequence
  Description of Artificial Sequence: Synthetic oligonucleotide
acagcatttattattaacta

SEQ ID NO: 4511 - DNA, 20 bp, Artificial Sequence
  Description of Artificial Sequence: Synthetic oligonucleotide
cagcatttattattaactat

SEQ ID NO: 4512 - DNA, 20 bp, Artificial Sequence
  Description of Artificial Sequence: Synthetic oligonucleotide
agcatttattattaactata

SEQ ID NO: 4513 - DNA, 20 bp, Artificial Sequence
  Description of Artificial Sequence: Synthetic oligonucleotide
gcatttattattaactataa

SEQ ID NO: 4514 - DNA, 20 bp, Artificial Sequence
  Description of Artificial Sequence: Synthetic oligonucleotide
catttattattaactataac

SEQ ID NO: 4515 - DNA, 20 bp, Artificial Sequence
  Description of Artificial Sequence: Synthetic oligonucleotide
atttattattaactataaca

SEQ ID NO: 4516 - DNA, 20 bp, Artificial Sequence
  Description of Artificial Sequence: Synthetic oligonucleotide
tttattattaactataacac

SEQ ID NO: 4517 - DNA, 20 bp, Artificial Sequence
  Description of Artificial Sequence: Synthetic oligonucleotide
ttattattaactataacacc

SEQ ID NO: 4518 - DNA, 20 bp, Artificial Sequence
  Description of Artificial Sequence: Synthetic oligonucleotide
tattattaactataacacca

SEQ ID NO: 4519 - DNA, 20 bp, Artificial Sequence
  Description of Artificial Sequence: Synthetic oligonucleotide
attattaactataacaccat

SEQ ID NO: 4520 - DNA, 20 bp, Artificial Sequence
  Description of Artificial Sequence: Synthetic oligonucleotide
ttattaactataacaccatc

SEQ ID NO: 4521 - DNA, 20 bp, Artificial Sequence
  Description of Artificial Sequence: Synthetic oligonucleotide
tattaactataacaccatct

SEQ ID NO: 4522 - DNA, 20 bp, Artificial Sequence
  Description of Artificial Sequence: Synthetic oligonucleotide
attaactataacaccatcta

SEQ ID NO: 4523 - DNA, 20 bp, Artificial Sequence
  Description of Artificial Sequence: Synthetic oligonucleotide
ttaactataacaccatctac

SEQ ID NO: 4524 - DNA, 20 bp, Artificial Sequence
  Description of Artificial Sequence: Synthetic oligonucleotide
taactataacaccatctacc

SEQ ID NO: 4525 - DNA, 20 bp, Artificial Sequence
  Description of Artificial Sequence: Synthetic oligonucleotide
aactataacaccatctacct

SEQ ID NO: 4526 - DNA, 20 bp, Artificial Sequence
  Description of Artificial Sequence: Synthetic oligonucleotide
actataacaccatctacctt

SEQ ID NO: 4527 - DNA, 20 bp, Artificial Sequence
  Description of Artificial Sequence: Synthetic oligonucleotide
ctataacaccatctaccttc

SEQ ID NO: 4528 - DNA, 20 bp, Artificial Sequence
  Description of Artificial Sequence: Synthetic oligonucleotide
tataacaccatctaccttca

SEQ ID NO: 4529 - DNA, 20 bp, Artificial Sequence
  Description of Artificial Sequence: Synthetic oligonucleotide
ataacaccatctaccttcag

SEQ ID NO: 4530 - DNA, 20 bp, Artificial Sequence
  Description of Artificial Sequence: Synthetic oligonucleotide
taacaccatctaccttcagt

SEQ ID NO: 4531 - DNA, 20 bp, Artificial Sequence
  Description of Artificial Sequence: Synthetic oligonucleotide
aacaccatctaccttcagtt

SEQ ID NO: 4532 - DNA, 20 bp, Artificial Sequence
  Description of Artificial Sequence: Synthetic oligonucleotide
acaccatctaccttcagttt

SEQ ID NO: 4533 - DNA, 20 bp, Artificial Sequence
  Description of Artificial Sequence: Synthetic oligonucleotide
caccatctaccttcagtttt

SEQ ID NO: 4534 - DNA, 20 bp, Artificial Sequence
  Description of Artificial Sequence: Synthetic oligonucleotide
accatctaccttcagttttc

SEQ ID NO: 4535 - DNA, 20 bp, Artificial Sequence
  Description of Artificial Sequence: Synthetic oligonucleotide
ccatctaccttcagttttca

SEQ ID NO: 4536 - DNA, 20 bp, Artificial Sequence
  Description of Artificial Sequence: Synthetic oligonucleotide
catctaccttcagttttcaa

SEQ ID NO: 4537 - DNA, 20 bp, Artificial Sequence
  Description of Artificial Sequence: Synthetic oligonucleotide
atctaccttcagttttcaac

SEQ ID NO: 4538 - DNA, 20 bp, Artificial Sequence
  Description of Artificial Sequence: Synthetic oligonucleotide
tctaccttcagttttcaacc

SEQ ID NO: 4539 - DNA, 20 bp, Artificial Sequence
  Description of Artificial Sequence: Synthetic oligonucleotide
ctaccttcagttttcaacca

SEQ ID NO: 4540 - DNA, 20 bp, Artificial Sequence
  Description of Artificial Sequence: Synthetic oligonucleotide
taccttcagttttcaaccat

SEQ ID NO: 4541 - DNA, 20 bp, Artificial Sequence
  Description of Artificial Sequence: Synthetic oligonucleotide
accttcagttttcaaccatt

SEQ ID NO: 4542 - DNA, 20 bp, Artificial Sequence
  Description of Artificial Sequence: Synthetic oligonucleotide
ccttcagttttcaaccattt

SEQ ID NO: 4543 - DNA, 20 bp, Artificial Sequence
  Description of Artificial Sequence: Synthetic oligonucleotide
cttcagttttcaaccatttc

SEQ ID NO: 4544 - DNA, 20 bp, Artificial Sequence
  Description of Artificial Sequence: Synthetic oligonucleotide
ttcagttttcaaccatttcc

SEQ ID NO: 4545 - DNA, 20 bp, Artificial Sequence
  Description of Artificial Sequence: Synthetic oligonucleotide
tcagttttcaaccatttcct

SEQ ID NO: 4546 - DNA, 20 bp, Artificial Sequence
  Description of Artificial Sequence: Synthetic oligonucleotide
cagttttcaaccatttccta

SEQ ID NO: 4547 - DNA, 20 bp, Artificial Sequence
  Description of Artificial Sequence: Synthetic oligonucleotide
agttttcaaccatttcctac

SEQ ID NO: 4548 - DNA, 20 bp, Artificial Sequence
  Description of Artificial Sequence: Synthetic oligonucleotide
gttttcaaccatttcctaca

SEQ ID NO: 4549 - DNA, 20 bp, Artificial Sequence
  Description of Artificial Sequence: Synthetic oligonucleotide
ttttcaaccatttcctacag

SEQ ID NO: 4550 - DNA, 20 bp, Artificial Sequence
  Description of Artificial Sequence: Synthetic oligonucleotide
tttcaaccatttcctacaga

SEQ ID NO: 4551 - DNA, 20 bp, Artificial Sequence
  Description of Artificial Sequence: Synthetic oligonucleotide
ttcaaccatttcctacagac

SEQ ID NO: 4552 - DNA, 20 bp, Artificial Sequence
  Description of Artificial Sequence: Synthetic oligonucleotide
tcaaccatttcctacagaca

SEQ ID NO: 4553 - DNA, 20 bp, Artificial Sequence
  Description of Artificial Sequence: Synthetic oligonucleotide
caaccatttcctacagacaa

SEQ ID NO: 4554 - DNA, 20 bp, Artificial Sequence
  Description of Artificial Sequence: Synthetic oligonucleotide
aaccatttcctacagacaaa

SEQ ID NO: 4555 - DNA, 20 bp, Artificial Sequence
  Description of Artificial Sequence: Synthetic oligonucleotide
accatttcctacagacaaaa

SEQ ID NO: 4556 - DNA, 20 bp, Artificial Sequence
  Description of Artificial Sequence: Synthetic oligonucleotide
ccatttcctacagacaaaat

SEQ ID NO: 4557 - DNA, 20 bp, Artificial Sequence
  Description of Artificial Sequence: Synthetic oligonucleotide
catttcctacagacaaaatt

SEQ ID NO: 4558 - DNA, 20 bp, Artificial Sequence
  Description of Artificial Sequence: Synthetic oligonucleotide
atttcctacagacaaaattt

SEQ ID NO: 4559 - DNA, 20 bp, Artificial Sequence
  Description of Artificial Sequence: Synthetic oligonucleotide
tttcctacagacaaaattta

SEQ ID NO: 4560 - DNA, 20 bp, Artificial Sequence
  Description of Artificial Sequence: Synthetic oligonucleotide
ttcctacagacaaaatttaa

SEQ ID NO: 4561 - DNA, 20 bp, Artificial Sequence
  Description of Artificial Sequence: Synthetic oligonucleotide
tcctacagacaaaatttaaa

SEQ ID NO: 4562 - DNA, 20 bp, Artificial Sequence
  Description of Artificial Sequence: Synthetic oligonucleotide
cctacagacaaaatttaaaa

SEQ ID NO: 4563 - DNA, 20 bp, Artificial Sequence
  Description of Artificial Sequence: Synthetic oligonucleotide
ctacagacaaaatttaaaag

SEQ ID NO: 4564 - DNA, 20 bp, Artificial Sequence
  Description of Artificial Sequence: Synthetic oligonucleotide
tacagacaaaatttaaaagg

SEQ ID NO: 4565 - DNA, 20 bp, Artificial Sequence
  Description of Artificial Sequence: Synthetic oligonucleotide
acagacaaaatttaaaagga

SEQ ID NO: 4566 - DNA, 20 bp, Artificial Sequence
  Description of Artificial Sequence: Synthetic oligonucleotide
cagacaaaatttaaaaggaa

SEQ ID NO: 4567 - DNA, 20 bp, Artificial Sequence
  Description of Artificial Sequence: Synthetic oligonucleotide
agacaaaatttaaaaggaag

SEQ ID NO: 4568 - DNA, 20 bp, Artificial Sequence
  Description of Artificial Sequence: Synthetic oligonucleotide
gacaaaatttaaaaggaagc

SEQ ID NO: 4569 - DNA, 20 bp, Artificial Sequence
  Description of Artificial Sequence: Synthetic oligonucleotide
acaaaatttaaaaggaagct

SEQ ID NO: 4570 - DNA, 20 bp, Artificial Sequence
  Description of Artificial Sequence: Synthetic oligonucleotide
caaaatttaaaaggaagctc

SEQ ID NO: 4571 - DNA, 20 bp, Artificial Sequence
  Description of Artificial Sequence: Synthetic oligonucleotide
aaaatttaaaaggaagctcc

SEQ ID NO: 4572 - DNA, 20 bp, Artificial Sequence
  Description of Artificial Sequence: Synthetic oligonucleotide
aaatttaaaaggaagctcct

SEQ ID NO: 4573 - DNA, 20 bp, Artificial Sequence
  Description of Artificial Sequence: Synthetic oligonucleotide
aatttaaaaggaagctcctt

SEQ ID NO: 4574 - DNA, 20 bp, Artificial Sequence
  Description of Artificial Sequence: Synthetic oligonucleotide
atttaaaaggaagctccttg

SEQ ID NO: 4575 - DNA, 20 bp, Artificial Sequence
  Description of Artificial Sequence: Synthetic oligonucleotide
tttaaaaggaagctccttga

SEQ ID NO: 4576 - DNA, 20 bp, Artificial Sequence
  Description of Artificial Sequence: Synthetic oligonucleotide
ttaaaaggaagctccttgag

SEQ ID NO: 4577 - DNA, 20 bp, Artificial Sequence
  Description of Artificial Sequence: Synthetic oligonucleotide
taaaaggaagctccttgagc

SEQ ID NO: 4578 - DNA, 20 bp, Artificial Sequence
  Description of Artificial Sequence: Synthetic oligonucleotide
aaaaggaagctccttgagct

SEQ ID NO: 4579 - DNA, 20 bp, Artificial Sequence
  Description of Artificial Sequence: Synthetic oligonucleotide
aaaggaagctccttgagctt

SEQ ID NO: 4580 - DNA, 20 bp, Artificial Sequence
  Description of Artificial Sequence: Synthetic oligonucleotide
aaggaagctccttgagcttg

SEQ ID NO: 4581 - DNA, 20 bp, Artificial Sequence
  Description of Artificial Sequence: Synthetic oligonucleotide
aggaagctccttgagcttgt

SEQ ID NO: 4582 - DNA, 20 bp, Artificial Sequence
  Description of Artificial Sequence: Synthetic oligonucleotide
ggaagctccttgagcttgtt

SEQ ID NO: 4583 - DNA, 20 bp, Artificial Sequence
  Description of Artificial Sequence: Synthetic oligonucleotide
gaagctccttgagcttgttt

SEQ ID NO: 4584 - DNA, 20 bp, Artificial Sequence
  Description of Artificial Sequence: Synthetic oligonucleotide
aagctccttgagcttgtttc

SEQ ID NO: 4585 - DNA, 20 bp, Artificial Sequence
  Description of Artificial Sequence: Synthetic oligonucleotide
agctccttgagcttgtttct

SEQ ID NO: 4586 - DNA, 20 bp, Artificial Sequence
  Description of Artificial Sequence: Synthetic oligonucleotide
gctccttgagcttgtttctt

SEQ ID NO: 4587 - DNA, 20 bp, Artificial Sequence
  Description of Artificial Sequence: Synthetic oligonucleotide
ctccttgagcttgtttctta

SEQ ID NO: 4588 - DNA, 20 bp, Artificial Sequence
  Description of Artificial Sequence: Synthetic oligonucleotide
tccttgagcttgtttcttac

SEQ ID NO: 4589 - DNA, 20 bp, Artificial Sequence
  Description of Artificial Sequence: Synthetic oligonucleotide
ccttgagcttgtttcttaca

SEQ ID NO: 4590 - DNA, 20 bp, Artificial Sequence
  Description of Artificial Sequence: Synthetic oligonucleotide
cttgagcttgtttcttacaa

SEQ ID NO: 4591 - DNA, 20 bp, Artificial Sequence
  Description of Artificial Sequence: Synthetic oligonucleotide
ttgagcttgtttcttacaaa

SEQ ID NO: 4592 - DNA, 20 bp, Artificial Sequence
  Description of Artificial Sequence: Synthetic oligonucleotide
tgagcttgtttcttacaaag

SEQ ID NO: 4593 - DNA, 20 bp, Artificial Sequence
  Description of Artificial Sequence: Synthetic oligonucleotide
gagcttgtttcttacaaagt

SEQ ID NO: 4594 - DNA, 20 bp, Artificial Sequence
  Description of Artificial Sequence: Synthetic oligonucleotide
agcttgtttcttacaaagta

SEQ ID NO: 4595 - DNA, 20 bp, Artificial Sequence
  Description of Artificial Sequence: Synthetic oligonucleotide
gcttgtttcttacaaagtaa

SEQ ID NO: 4596 - DNA, 20 bp, Artificial Sequence
  Description of Artificial Sequence: Synthetic oligonucleotide
cttgtttcttacaaagtaaa

SEQ ID NO: 4597 - DNA, 20 bp, Artificial Sequence
  Description of Artificial Sequence: Synthetic oligonucleotide
ttgtttcttacaaagtaaat

SEQ ID NO: 4598 - DNA, 20 bp, Artificial Sequence
  Description of Artificial Sequence: Synthetic oligonucleotide
tgtttcttacaaagtaaata

SEQ ID NO: 4599 - DNA, 20 bp, Artificial Sequence
  Description of Artificial Sequence: Synthetic oligonucleotide
gtttcttacaaagtaaataa

SEQ ID NO: 4600 - DNA, 20 bp, Artificial Sequence
  Description of Artificial Sequence: Synthetic oligonucleotide
tttcttacaaagtaaataaa

SEQ ID NO: 4601 - DNA, 20 bp, Artificial Sequence
  Description of Artificial Sequence: Synthetic oligonucleotide
ttcttacaaagtaaataaaa

SEQ ID NO: 4602 - DNA, 20 bp, Artificial Sequence
  Description of Artificial Sequence: Synthetic oligonucleotide
tcttacaaagtaaataaaaa

SEQ ID NO: 4603 - DNA, 20 bp, Artificial Sequence
  Description of Artificial Sequence: Synthetic oligonucleotide
cttacaaagtaaataaaaat

SEQ ID NO: 4604 - DNA, 20 bp, Artificial Sequence
  Description of Artificial Sequence: Synthetic oligonucleotide
ttacaaagtaaataaaaata

SEQ ID NO: 4605 - DNA, 20 bp, Artificial Sequence
  Description of Artificial Sequence: Synthetic oligonucleotide
tacaaagtaaataaaaatag

SEQ ID NO: 4606 - DNA, 20 bp, Artificial Sequence
  Description of Artificial Sequence: Synthetic oligonucleotide
acaaagtaaataaaaataga

SEQ ID NO: 4607 - DNA, 20 bp, Artificial Sequence
  Description of Artificial Sequence: Synthetic oligonucleotide
caaagtaaataaaaatagat

SEQ ID NO: 4608 - DNA, 20 bp, Artificial Sequence
  Description of Artificial Sequence: Synthetic oligonucleotide
aaagtaaataaaaatagata

SEQ ID NO: 4609 - DNA, 20 bp, Artificial Sequence
  Description of Artificial Sequence: Synthetic oligonucleotide
aagtaaataaaaatagatat

SEQ ID NO: 4610 - DNA, 20 bp, Artificial Sequence
  Description of Artificial Sequence: Synthetic oligonucleotide
agtaaataaaaatagatata

SEQ ID NO: 4611 - DNA, 20 bp, Artificial Sequence
  Description of Artificial Sequence: Synthetic oligonucleotide
gtaaataaaaatagatatac

SEQ ID NO: 4612 - DNA, 20 bp, Artificial Sequence
  Description of Artificial Sequence: Synthetic oligonucleotide
taaataaaaatagatatacc

SEQ ID NO: 4613 - DNA, 20 bp, Artificial Sequence
  Description of Artificial Sequence: Synthetic oligonucleotide
aaataaaaatagatatacct

SEQ ID NO: 4614 - DNA, 20 bp, Artificial Sequence
  Description of Artificial Sequence: Synthetic oligonucleotide
aataaaaatagatatacctg

SEQ ID NO: 4615 - DNA, 20 bp, Artificial Sequence
  Description of Artificial Sequence: Synthetic oligonucleotide
ataaaaatagatatacctgt

SEQ ID NO: 4616 - DNA, 20 bp, Artificial Sequence
  Description of Artificial Sequence: Synthetic oligonucleotide
taaaaatagatatacctgta

SEQ ID NO: 4617 - DNA, 20 bp, Artificial Sequence
  Description of Artificial Sequence: Synthetic oligonucleotide
aaaaatagatatacctgtat

SEQ ID NO: 4618 - DNA, 20 bp, Artificial Sequence
  Description of Artificial Sequence: Synthetic oligonucleotide
aaaatagatatacctgtatt

SEQ ID NO: 4619 - DNA, 20 bp, Artificial Sequence
  Description of Artificial Sequence: Synthetic oligonucleotide
aaatagatatacctgtatta

SEQ ID NO: 4620 - DNA, 20 bp, Artificial Sequence
  Description of Artificial Sequence: Synthetic oligonucleotide
aatagatatacctgtattaa

SEQ ID NO: 4621 - DNA, 20 bp, Artificial Sequence
  Description of Artificial Sequence: Synthetic oligonucleotide
atagatatacctgtattaac

SEQ ID NO: 4622 - DNA, 20 bp, Artificial Sequence
  Description of Artificial Sequence: Synthetic oligonucleotide
tagatatacctgtattaact

SEQ ID NO: 4623 - DNA, 20 bp, Artificial Sequence
  Description of Artificial Sequence: Synthetic oligonucleotide
agatatacctgtattaacta

SEQ ID NO: 4624 - DNA, 20 bp, Artificial Sequence
  Description of Artificial Sequence: Synthetic oligonucleotide
gatatacctgtattaactat

SEQ ID NO: 4625 - DNA, 20 bp, Artificial Sequence
  Description of Artificial Sequence: Synthetic oligonucleotide
atatacctgtattaactatg

SEQ ID NO: 4626 - DNA, 20 bp, Artificial Sequence
  Description of Artificial Sequence: Synthetic oligonucleotide
tatacctgtattaactatga

SEQ ID NO: 4627 - DNA, 20 bp, Artificial Sequence
  Description of Artificial Sequence: Synthetic oligonucleotide
atacctgtattaactatgaa

SEQ ID NO: 4628 - DNA, 20 bp, Artificial Sequence
  Description of Artificial Sequence: Synthetic oligonucleotide
tacctgtattaactatgaat

SEQ ID NO: 4629 - DNA, 20 bp, Artificial Sequence
  Description of Artificial Sequence: Synthetic oligonucleotide
acctgtattaactatgaata

SEQ ID NO: 4630 - DNA, 20 bp, Artificial Sequence
  Description of Artificial Sequence: Synthetic oligonucleotide
cctgtattaactatgaatat

SEQ ID NO: 4631 - DNA, 20 bp, Artificial Sequence
  Description of Artificial Sequence: Synthetic oligonucleotide
ctgtattaactatgaatatt

SEQ ID NO: 4632 - DNA, 20 bp, Artificial Sequence
  Description of Artificial Sequence: Synthetic oligonucleotide
tgtattaactatgaatattt

SEQ ID NO: 4633 - DNA, 20 bp, Artificial Sequence
  Description of Artificial Sequence: Synthetic oligonucleotide
gtattaactatgaatatttt

SEQ ID NO: 4634 - DNA, 20 bp, Artificial Sequence
  Description of Artificial Sequence: Synthetic oligonucleotide
tattaactatgaatatttta

SEQ ID NO: 4635 - DNA, 20 bp, Artificial Sequence
  Description of Artificial Sequence: Synthetic oligonucleotide
attaactatgaatattttaa

SEQ ID NO: 4636 - DNA, 20 bp, Artificial Sequence
  Description of Artificial Sequence: Synthetic oligonucleotide
ttaactatgaatattttaag

SEQ ID NO: 4637 - DNA, 20 bp, Artificial Sequence
  Description of Artificial Sequence: Synthetic oligonucleotide
taactatgaatattttaagg

SEQ ID NO: 4638 - DNA, 20 bp, Artificial Sequence
  Description of Artificial Sequence: Synthetic oligonucleotide
aactatgaatattttaaggc

SEQ ID NO: 4639 - DNA, 20 bp, Artificial Sequence
  Description of Artificial Sequence: Synthetic oligonucleotide
actatgaatattttaaggca

SEQ ID NO: 4640 - DNA, 20 bp, Artificial Sequence
  Description of Artificial Sequence: Synthetic oligonucleotide
ctatgaatattttaaggcag

SEQ ID NO: 4641 - DNA, 20 bp, Artificial Sequence
  Description of Artificial Sequence: Synthetic oligonucleotide
tatgaatattttaaggcagt

SEQ ID NO: 4642 - DNA, 20 bp, Artificial Sequence
  Description of Artificial Sequence: Synthetic oligonucleotide
atgaatattttaaggcagtt

SEQ ID NO: 4643 - DNA, 20 bp, Artificial Sequence
  Description of Artificial Sequence: Synthetic oligonucleotide
tgaatattttaaggcagttt

SEQ ID NO: 4644 - DNA, 20 bp, Artificial Sequence
  Description of Artificial Sequence: Synthetic oligonucleotide
gaatattttaaggcagtttt

SEQ ID NO: 4645 - DNA, 20 bp, Artificial Sequence
  Description of Artificial Sequence: Synthetic oligonucleotide
aatattttaaggcagttttg

SEQ ID NO: 4646 - DNA, 20 bp, Artificial Sequence
  Description of Artificial Sequence: Synthetic oligonucleotide
atattttaaggcagttttgt

SEQ ID NO: 4647 - DNA, 20 bp, Artificial Sequence
  Description of Artificial Sequence: Synthetic oligonucleotide
tattttaaggcagttttgtg

SEQ ID NO: 4648 - DNA, 20 bp, Artificial Sequence
  Description of Artificial Sequence: Synthetic oligonucleotide
attttaaggcagttttgtgc

SEQ ID NO: 4649 - DNA, 20 bp, Artificial Sequence
  Description of Artificial Sequence: Synthetic oligonucleotide
ttttaaggcagttttgtgcc

SEQ ID NO: 4650 - DNA, 20 bp, Artificial Sequence
  Description of Artificial Sequence: Synthetic oligonucleotide
tttaaggcagttttgtgccg

SEQ ID NO: 4651 - DNA, 20 bp, Artificial Sequence
  Description of Artificial Sequence: Synthetic oligonucleotide
ttaaggcagttttgtgccgg

SEQ ID NO: 4652 - DNA, 20 bp, Artificial Sequence
  Description of Artificial Sequence: Synthetic oligonucleotide
taaggcagttttgtgccggc

SEQ ID NO: 4653 - DNA, 20 bp, Artificial Sequence
  Description of Artificial Sequence: Synthetic oligonucleotide
aaggcagttttgtgccggca

SEQ ID NO: 4654 - DNA, 20 bp, Artificial Sequence
  Description of Artificial Sequence: Synthetic oligonucleotide
aggcagttttgtgccggcat

SEQ ID NO: 4655 - DNA, 20 bp, Artificial Sequence
  Description of Artificial Sequence: Synthetic oligonucleotide
ggcagttttgtgccggcatc

SEQ ID NO: 4656 - DNA, 20 bp, Artificial Sequence
  Description of Artificial Sequence: Synthetic oligonucleotide
gcagttttgtgccggcatcc

SEQ ID NO: 4657 - DNA, 20 bp, Artificial Sequence
  Description of Artificial Sequence: Synthetic oligonucleotide
cagttttgtgccggcatcca

SEQ ID NO: 4658 - DNA, 20 bp, Artificial Sequence
  Description of Artificial Sequence: Synthetic oligonucleotide
agttttgtgccggcatccat

SEQ ID NO: 4659 - DNA, 20 bp, Artificial Sequence
  Description of Artificial Sequence: Synthetic oligonucleotide
gttttgtgccggcatccatg

SEQ ID NO: 4660 - DNA, 20 bp, Artificial Sequence
  Description of Artificial Sequence: Synthetic oligonucleotide
ttttgtgccggcatccatga

SEQ ID NO: 4661 - DNA, 20 bp, Artificial Sequence
  Description of Artificial Sequence: Synthetic oligonucleotide
tttgtgccggcatccatgag

SEQ ID NO: 4662 - DNA, 20 bp, Artificial Sequence
  Description of Artificial Sequence: Synthetic oligonucleotide
ttgtgccggcatccatgaga

SEQ ID NO: 4663 - DNA, 20 bp, Artificial Sequence
  Description of Artificial Sequence: Synthetic oligonucleotide
tgtgccggcatccatgagag

SEQ ID NO: 4664 - DNA, 20 bp, Artificial Sequence
  Description of Artificial Sequence: Synthetic oligonucleotide
gtgccggcatccatgagaga

SEQ ID NO: 4665 - DNA, 20 bp, Artificial Sequence
  Description of Artificial Sequence: Synthetic oligonucleotide
tgccggcatccatgagagac

SEQ ID NO: 4666 - DNA, 20 bp, Artificial Sequence
  Description of Artificial Sequence: Synthetic oligonucleotide
gccggcatccatgagagact

SEQ ID NO: 4667 - DNA, 20 bp, Artificial Sequence
  Description of Artificial Sequence: Synthetic oligonucleotide
ccggcatccatgagagactc

SEQ ID NO: 4668 - DNA, 20 bp, Artificial Sequence
  Description of Artificial Sequence: Synthetic oligonucleotide
cggcatccatgagagactct

SEQ ID NO: 4669 - DNA, 20 bp, Artificial Sequence
  Description of Artificial Sequence: Synthetic oligonucleotide
ggcatccatgagagactctg

SEQ ID NO: 4670 - DNA, 20 bp, Artificial Sequence
  Description of Artificial Sequence: Synthetic oligonucleotide
gcatccatgagagactctgt

SEQ ID NO: 4671 - DNA, 20 bp, Artificial Sequence
  Description of Artificial Sequence: Synthetic oligonucleotide
catccatgagagactctgtc

SEQ ID NO: 4672 - DNA, 20 bp, Artificial Sequence
  Description of Artificial Sequence: Synthetic oligonucleotide
atccatgagagactctgtcc

SEQ ID NO: 4673 - DNA, 20 bp, Artificial Sequence
  Description of Artificial Sequence: Synthetic oligonucleotide
tccatgagagactctgtcca

SEQ ID NO: 4674 - DNA, 20 bp, Artificial Sequence
  Description of Artificial Sequence: Synthetic oligonucleotide
ccatgagagactctgtccac

SEQ ID NO: 4675 - DNA, 20 bp, Artificial Sequence
  Description of Artificial Sequence: Synthetic oligonucleotide
catgagagactctgtccacc

SEQ ID NO: 4676 - DNA, 20 bp, Artificial Sequence
  Description of Artificial Sequence: Synthetic oligonucleotide
atgagagactctgtccacct

SEQ ID NO: 4677 - DNA, 20 bp, Artificial Sequence
  Description of Artificial Sequence: Synthetic oligonucleotide
tgagagactctgtccacctc

SEQ ID NO: 4678 - DNA, 20 bp, Artificial Sequence
  Description of Artificial Sequence: Synthetic oligonucleotide
gagagactctgtccacctcc

SEQ ID NO: 4679 - DNA, 20 bp, Artificial Sequence
  Description of Artificial Sequence: Synthetic oligonucleotide
agagactctgtccacctcct

SEQ ID NO: 4680 - DNA, 20 bp, Artificial Sequence
  Description of Artificial Sequence: Synthetic oligonucleotide
gagactctgtccacctcctg

SEQ ID NO: 4681 - DNA, 20 bp, Artificial Sequence
  Description of Artificial Sequence: Synthetic oligonucleotide
agactctgtccacctcctgc

SEQ ID NO: 4682 - DNA, 20 bp, Artificial Sequence
  Description of Artificial Sequence: Synthetic oligonucleotide
gactctgtccacctcctgct

SEQ ID NO: 4683 - DNA, 20 bp, Artificial Sequence
  Description of Artificial Sequence: Synthetic oligonucleotide
actctgtccacctcctgctg

SEQ ID NO: 4684 - DNA, 20 bp, Artificial Sequence
  Description of Artificial Sequence: Synthetic oligonucleotide
ctctgtccacctcctgctgg

SEQ ID NO: 4685 - DNA, 20 bp, Artificial Sequence
  Description of Artificial Sequence: Synthetic oligonucleotide
tctgtccacctcctgctggt

SEQ ID NO: 4686 - DNA, 20 bp, Artificial Sequence
  Description of Artificial Sequence: Synthetic oligonucleotide
ctgtccacctcctgctggtg

SEQ ID NO: 4687 - DNA, 20 bp, Artificial Sequence
  Description of Artificial Sequence: Synthetic oligonucleotide
tgtccacctcctgctggtgc

SEQ ID NO: 4688 - DNA, 20 bp, Artificial Sequence
  Description of Artificial Sequence: Synthetic oligonucleotide
gtccacctcctgctggtgct

SEQ ID NO: 4689 - DNA, 20 bp, Artificial Sequence
  Description of Artificial Sequence: Synthetic oligonucleotide
tccacctcctgctggtgctt

SEQ ID NO: 4690 - DNA, 20 bp, Artificial Sequence
  Description of Artificial Sequence: Synthetic oligonucleotide
ccacctcctgctggtgcttc

SEQ ID NO: 4691 - DNA, 20 bp, Artificial Sequence
  Description of Artificial Sequence: Synthetic oligonucleotide
cacctcctgctggtgcttca

SEQ ID NO: 4692 - DNA, 20 bp, Artificial Sequence
  Description of Artificial Sequence: Synthetic oligonucleotide
acctcctgctggtgcttcat

SEQ ID NO: 4693 - DNA, 20 bp, Artificial Sequence
  Description of Artificial Sequence: Synthetic oligonucleotide
cctcctgctggtgcttcatt

SEQ ID NO: 4694 - DNA, 20 bp, Artificial Sequence
  Description of Artificial Sequence: Synthetic oligonucleotide
ctcctgctggtgcttcattc

SEQ ID NO: 4695 - DNA, 20 bp, Artificial Sequence
  Description of Artificial Sequence: Synthetic oligonucleotide
tcctgctggtgcttcattcc

SEQ ID NO: 4696 - DNA, 20 bp, Artificial Sequence
  Description of Artificial Sequence: Synthetic oligonucleotide
cctgctggtgcttcattcct

SEQ ID NO: 4697 - DNA, 20 bp, Artificial Sequence
  Description of Artificial Sequence: Synthetic oligonucleotide
ctgctggtgcttcattcctt

SEQ ID NO: 4698 - DNA, 20 bp, Artificial Sequence
  Description of Artificial Sequence: Synthetic oligonucleotide
tgctggtgcttcattccttt

SEQ ID NO: 4699 - DNA, 20 bp, Artificial Sequence
  Description of Artificial Sequence: Synthetic oligonucleotide
gctggtgcttcattcctttc

SEQ ID NO: 4700 - DNA, 20 bp, Artificial Sequence
  Description of Artificial Sequence: Synthetic oligonucleotide
ctggtgcttcattcctttca

SEQ ID NO: 4701 - DNA, 20 bp, Artificial Sequence
  Description of Artificial Sequence: Synthetic oligonucleotide
tggtgcttcattcctttcag

SEQ ID NO: 4702 - DNA, 20 bp, Artificial Sequence
  Description of Artificial Sequence: Synthetic oligonucleotide
ggtgcttcattcctttcagt

SEQ ID NO: 4703 - DNA, 20 bp, Artificial Sequence
  Description of Artificial Sequence: Synthetic oligonucleotide
gtgcttcattcctttcagtg

SEQ ID NO: 4704 - DNA, 20 bp, Artificial Sequence
  Description of Artificial Sequence: Synthetic oligonucleotide
tgcttcattcctttcagtgc

SEQ ID NO: 4705 - DNA, 20 bp, Artificial Sequence
  Description of Artificial Sequence: Synthetic oligonucleotide
gcttcattcctttcagtgct

SEQ ID NO: 4706 - DNA, 20 bp, Artificial Sequence
  Description of Artificial Sequence: Synthetic oligonucleotide
cttcattcctttcagtgctg

SEQ ID NO: 4707 - DNA, 20 bp, Artificial Sequence
  Description of Artificial Sequence: Synthetic oligonucleotide
ttcattcctttcagtgctgt

SEQ ID NO: 4708 - DNA, 20 bp, Artificial Sequence
  Description of Artificial Sequence: Synthetic oligonucleotide
tcattcctttcagtgctgta

SEQ ID NO: 4709 - DNA, 20 bp, Artificial Sequence
  Description of Artificial Sequence: Synthetic oligonucleotide
cattcctttcagtgctgtac

SEQ ID NO: 4710 - DNA, 20 bp, Artificial Sequence
  Description of Artificial Sequence: Synthetic oligonucleotide
attcctttcagtgctgtaca

SEQ ID NO: 4711 - DNA, 20 bp, Artificial Sequence
  Description of Artificial Sequence: Synthetic oligonucleotide
ttcctttcagtgctgtacat

SEQ ID NO: 4712 - DNA, 20 bp, Artificial Sequence
  Description of Artificial Sequence: Synthetic oligonucleotide
tcctttcagtgctgtacatg

SEQ ID NO: 4713 - DNA, 20 bp, Artificial Sequence
  Description of Artificial Sequence: Synthetic oligonucleotide
cctttcagtgctgtacatga

SEQ ID NO: 4714 - DNA, 20 bp, Artificial Sequence
  Description of Artificial Sequence: Synthetic oligonucleotide
ctttcagtgctgtacatgac

SEQ ID NO: 4715 - DNA, 20 bp, Artificial Sequence
  Description of Artificial Sequence: Synthetic oligonucleotide
tttcagtgctgtacatgacc

SEQ ID NO: 4716 - DNA, 20 bp, Artificial Sequence
  Description of Artificial Sequence: Synthetic oligonucleotide
ttcagtgctgtacatgacca

SEQ ID NO: 4717 - DNA, 20 bp, Artificial Sequence
  Description of Artificial Sequence: Synthetic oligonucleotide
tcagtgctgtacatgaccaa

SEQ ID NO: 4718 - DNA, 20 bp, Artificial Sequence
  Description of Artificial Sequence: Synthetic oligonucleotide
cagtgctgtacatgaccaag

SEQ ID NO: 4719 - DNA, 20 bp, Artificial Sequence
  Description of Artificial Sequence: Synthetic oligonucleotide
agtgctgtacatgaccaagg

SEQ ID NO: 4720 - DNA, 20 bp, Artificial Sequence
  Description of Artificial Sequence: Synthetic oligonucleotide
gtgctgtacatgaccaaggc

SEQ ID NO: 4721 - DNA, 20 bp, Artificial Sequence
  Description of Artificial Sequence: Synthetic oligonucleotide
tgctgtacatgaccaaggcg

SEQ ID NO: 4722 - DNA, 20 bp, Artificial Sequence
  Description of Artificial Sequence: Synthetic oligonucleotide
gctgtacatgaccaaggcga

SEQ ID NO: 4723 - DNA, 20 bp, Artificial Sequence
  Description of Artificial Sequence: Synthetic oligonucleotide
ctgtacatgaccaaggcgag

SEQ ID NO: 4724 - DNA, 20 bp, Artificial Sequence
  Description of Artificial Sequence: Synthetic oligonucleotide
tgtacatgaccaaggcgagc

SEQ ID NO: 4725 - DNA, 20 bp, Artificial Sequence
  Description of Artificial Sequence: Synthetic oligonucleotide
gtacatgaccaaggcgagca

SEQ ID NO: 4726 - DNA, 20 bp, Artificial Sequence
  Description of Artificial Sequence: Synthetic oligonucleotide
tacatgaccaaggcgagcag

SEQ ID NO: 4727 - DNA, 20 bp, Artificial Sequence
  Description of Artificial Sequence: Synthetic oligonucleotide
acatgaccaaggcgagcagg

SEQ ID NO: 4728 - DNA, 20 bp, Artificial Sequence
  Description of Artificial Sequence: Synthetic oligonucleotide
catgaccaaggcgagcaggg

SEQ ID NO: 4729 - DNA, 20 bp, Artificial Sequence
  Description of Artificial Sequence: Synthetic oligonucleotide
atgaccaaggcgagcagggg

SEQ ID NO: 4730 - DNA, 20 bp, Artificial Sequence
  Description of Artificial Sequence: Synthetic oligonucleotide
tgaccaaggcgagcaggggc

SEQ ID NO: 4731 - DNA, 20 bp, Artificial Sequence
  Description of Artificial Sequence: Synthetic oligonucleotide
gaccaaggcgagcaggggca

SEQ ID NO: 4732 - DNA, 20 bp, Artificial Sequence
  Description of Artificial Sequence: Synthetic oligonucleotide
accaaggcgagcaggggcag

SEQ ID NO: 4733 - DNA, 20 bp, Artificial Sequence
  Description of Artificial Sequence: Synthetic oligonucleotide
ccaaggcgagcaggggcagt

SEQ ID NO: 4734 - DNA, 20 bp, Artificial Sequence
  Description of Artificial Sequence: Synthetic oligonucleotide
caaggcgagcaggggcagtg

SEQ ID NO: 4735 - DNA, 20 bp, Artificial Sequence
  Description of Artificial Sequence: Synthetic oligonucleotide
aaggcgagcaggggcagtgc

SEQ ID NO: 4736 - DNA, 20 bp, Artificial Sequence
  Description of Artificial Sequence: Synthetic oligonucleotide
aggcgagcaggggcagtgct

SEQ ID NO: 4737 - DNA, 20 bp, Artificial Sequence
  Description of Artificial Sequence: Synthetic oligonucleotide
ggcgagcaggggcagtgctc

SEQ ID NO: 4738 - DNA, 20 bp, Artificial Sequence
  Description of Artificial Sequence: Synthetic oligonucleotide
gcgagcaggggcagtgctca

SEQ ID NO: 4739 - DNA, 20 bp, Artificial Sequence
  Description of Artificial Sequence: Synthetic oligonucleotide
cgagcaggggcagtgctcag

SEQ ID NO: 4740 - DNA, 20 bp, Artificial Sequence
  Description of Artificial Sequence: Synthetic oligonucleotide
gagcaggggcagtgctcaga

SEQ ID NO: 4741 - DNA, 20 bp, Artificial Sequence
  Description of Artificial Sequence: Synthetic oligonucleotide
agcaggggcagtgctcagag

SEQ ID NO: 4742 - DNA, 20 bp, Artificial Sequence
  Description of Artificial Sequence: Synthetic oligonucleotide
gcaggggcagtgctcagagt

SEQ ID NO: 4743 - DNA, 20 bp, Artificial Sequence
  Description of Artificial Sequence: Synthetic oligonucleotide
caggggcagtgctcagagtc

SEQ ID NO: 4744 - DNA, 20 bp, Artificial Sequence
  Description of Artificial Sequence: Synthetic oligonucleotide
aggggcagtgctcagagtct

SEQ ID NO: 4745 - DNA, 20 bp, Artificial Sequence
  Description of Artificial Sequence: Synthetic oligonucleotide
ggggcagtgctcagagtctg

SEQ ID NO: 4746 - DNA, 20 bp, Artificial Sequence
  Description of Artificial Sequence: Synthetic oligonucleotide
gggcagtgctcagagtctga

SEQ ID NO: 4747 - DNA, 20 bp, Artificial Sequence
  Description of Artificial Sequence: Synthetic oligonucleotide
ggcagtgctcagagtctgat

SEQ ID NO: 4748 - DNA, 20 bp, Artificial Sequence
  Description of Artificial Sequence: Synthetic oligonucleotide
gcagtgctcagagtctgatc

SEQ ID NO: 4749 - DNA, 20 bp, Artificial Sequence
  Description of Artificial Sequence: Synthetic oligonucleotide
cagtgctcagagtctgatcg

SEQ ID NO: 4750 - DNA, 20 bp, Artificial Sequence
  Description of Artificial Sequence: Synthetic oligonucleotide
agtgctcagagtctgatcgc

SEQ ID NO: 4751 - DNA, 20 bp, Artificial Sequence
  Description of Artificial Sequence: Synthetic oligonucleotide
gtgctcagagtctgatcgcc

SEQ ID NO: 4752 - DNA, 20 bp, Artificial Sequence
  Description of Artificial Sequence: Synthetic oligonucleotide
tgctcagagtctgatcgcca

SEQ ID NO: 4753 - DNA, 20 bp, Artificial Sequence
  Description of Artificial Sequence: Synthetic oligonucleotide
gctcagagtctgatcgccag

SEQ ID NO: 4754 - DNA, 20 bp, Artificial Sequence
  Description of Artificial Sequence: Synthetic oligonucleotide
ctcagagtctgatcgccaga

SEQ ID NO: 4755 - DNA, 20 bp, Artificial Sequence
  Description of Artificial Sequence: Synthetic oligonucleotide
tcagagtctgatcgccagat

SEQ ID NO: 4756 - DNA, 20 bp, Artificial Sequence
  Description of Artificial Sequence: Synthetic oligonucleotide
cagagtctgatcgccagatg

SEQ ID NO: 4757 - DNA, 20 bp, Artificial Sequence
  Description of Artificial Sequence: Synthetic oligonucleotide
agagtctgatcgccagatgc

SEQ ID NO: 4758 - DNA, 20 bp, Artificial Sequence
  Description of Artificial Sequence: Synthetic oligonucleotide
gagtctgatcgccagatgca

SEQ ID NO: 4759 - DNA, 20 bp, Artificial Sequence
  Description of Artificial Sequence: Synthetic oligonucleotide
agtctgatcgccagatgcag

SEQ ID NO: 4760 - DNA, 20 bp, Artificial Sequence
  Description of Artificial Sequence: Synthetic oligonucleotide
gtctgatcgccagatgcagt

SEQ ID NO: 4761 - DNA, 20 bp, Artificial Sequence
  Description of Artificial Sequence: Synthetic oligonucleotide
tctgatcgccagatgcagtg

SEQ ID NO: 4762 - DNA, 20 bp, Artificial Sequence
  Description of Artificial Sequence: Synthetic oligonucleotide
ctgatcgccagatgcagtgc

SEQ ID NO: 4763 - DNA, 20 bp, Artificial Sequence
  Description of Artificial Sequence: Synthetic oligonucleotide
tgatcgccagatgcagtgcc

SEQ ID NO: 4764 - DNA, 20 bp, Artificial Sequence
  Description of Artificial Sequence: Synthetic oligonucleotide
gatcgccagatgcagtgccc

SEQ ID NO: 4765 - DNA, 20 bp, Artificial Sequence
  Description of Artificial Sequence: Synthetic oligonucleotide
atcgccagatgcagtgccct

SEQ ID NO: 4766 - DNA, 20 bp, Artificial Sequence
  Description of Artificial Sequence: Synthetic oligonucleotide
tcgccagatgcagtgccctg

SEQ ID NO: 4767 - DNA, 20 bp, Artificial Sequence
  Description of Artificial Sequence: Synthetic oligonucleotide
cgccagatgcagtgccctgg

SEQ ID NO: 4768 - DNA, 20 bp, Artificial Sequence
  Description of Artificial Sequence: Synthetic oligonucleotide
gccagatgcagtgccctgga

SEQ ID NO: 4769 - DNA, 20 bp, Artificial Sequence
  Description of Artificial Sequence: Synthetic oligonucleotide
ccagatgcagtgccctggag

SEQ ID NO: 4770 - DNA, 20 bp, Artificial Sequence
  Description of Artificial Sequence: Synthetic oligonucleotide
cagatgcagtgccctggagt

SEQ ID NO: 4771 - DNA, 20 bp, Artificial Sequence
  Description of Artificial Sequence: Synthetic oligonucleotide
agatgcagtgccctggagtt

SEQ ID NO: 4772 - DNA, 20 bp, Artificial Sequence
  Description of Artificial Sequence: Synthetic oligonucleotide
gatgcagtgccctggagttt

SEQ ID NO: 4773 - DNA, 20 bp, Artificial Sequence
  Description of Artificial Sequence: Synthetic oligonucleotide
atgcagtgccctggagtttc

SEQ ID NO: 4774 - DNA, 20 bp, Artificial Sequence
  Description of Artificial Sequence: Synthetic oligonucleotide
tgcagtgccctggagtttcc

SEQ ID NO: 4775 - DNA, 20 bp, Artificial Sequence
  Description of Artificial Sequence: Synthetic oligonucleotide
gcagtgccctggagtttcct

SEQ ID NO: 4776 - DNA, 20 bp, Artificial Sequence
  Description of Artificial Sequence: Synthetic oligonucleotide
cagtgccctggagtttcctc

SEQ ID NO: 4777 - DNA, 20 bp, Artificial Sequence
  Description of Artificial Sequence: Synthetic oligonucleotide
agtgccctggagtttcctcc

SEQ ID NO: 4778 - DNA, 20 bp, Artificial Sequence
  Description of Artificial Sequence: Synthetic oligonucleotide
gtgccctggagtttcctccc

SEQ ID NO: 4779 - DNA, 20 bp, Artificial Sequence
  Description of Artificial Sequence: Synthetic oligonucleotide
tgccctggagtttcctcccc

SEQ ID NO: 4780 - DNA, 20 bp, Artificial Sequence
  Description of Artificial Sequence: Synthetic oligonucleotide
gccctggagtttcctccccg

SEQ ID NO: 4781 - DNA, 20 bp, Artificial Sequence
  Description of Artificial Sequence: Synthetic oligonucleotide
ccctggagtttcctccccgc

SEQ ID NO: 4782 - DNA, 20 bp, Artificial Sequence
  Description of Artificial Sequence: Synthetic oligonucleotide
cctggagtttcctccccgca

SEQ ID NO: 4783 - DNA, 20 bp, Artificial Sequence
  Description of Artificial Sequence: Synthetic oligonucleotide
ctggagtttcctccccgcaa

SEQ ID NO: 4784 - DNA, 20 bp, Artificial Sequence
  Description of Artificial Sequence: Synthetic oligonucleotide
tggagtttcctccccgcaag

SEQ ID NO: 4785 - DNA, 20 bp, Artificial Sequence
  Description of Artificial Sequence: Synthetic oligonucleotide
ggagtttcctccccgcaagt

SEQ ID NO: 4786 - DNA, 20 bp, Artificial Sequence
  Description of Artificial Sequence: Synthetic oligonucleotide
gagtttcctccccgcaagtc

SEQ ID NO: 4787 - DNA, 20 bp, Artificial Sequence
  Description of Artificial Sequence: Synthetic oligonucleotide
agtttcctccccgcaagtcc

SEQ ID NO: 4788 - DNA, 20 bp, Artificial Sequence
  Description of Artificial Sequence: Synthetic oligonucleotide
gtttcctccccgcaagtcca

SEQ ID NO: 4789 - DNA, 20 bp, Artificial Sequence
  Description of Artificial Sequence: Synthetic oligonucleotide
tttcctccccgcaagtccag

SEQ ID NO: 4790 - DNA, 20 bp, Artificial Sequence
  Description of Artificial Sequence: Synthetic oligonucleotide
ttcctccccgcaagtccagc

SEQ ID NO: 4791 - DNA, 20 bp, Artificial Sequence
  Description of Artificial Sequence: Synthetic oligonucleotide
tcctccccgcaagtccagcc

SEQ ID NO: 4792 - DNA, 20 bp, Artificial Sequence
  Description of Artificial Sequence: Synthetic oligonucleotide
cctccccgcaagtccagcct

SEQ ID NO: 4793 - DNA, 20 bp, Artificial Sequence
  Description of Artificial Sequence: Synthetic oligonucleotide
ctccccgcaagtccagcctg

SEQ ID NO: 4794 - DNA, 20 bp, Artificial Sequence
  Description of Artificial Sequence: Synthetic oligonucleotide
tccccgcaagtccagcctgg

SEQ ID NO: 4795 - DNA, 20 bp, Artificial Sequence
  Description of Artificial Sequence: Synthetic oligonucleotide
ccccgcaagtccagcctggg

SEQ ID NO: 4796 - DNA, 20 bp, Artificial Sequence
  Description of Artificial Sequence: Synthetic oligonucleotide
cccgcaagtccagcctgggt

SEQ ID NO: 4797 - DNA, 20 bp, Artificial Sequence
  Description of Artificial Sequence: Synthetic oligonucleotide
ccgcaagtccagcctgggtc

SEQ ID NO: 4798 - DNA, 20 bp, Artificial Sequence
  Description of Artificial Sequence: Synthetic oligonucleotide
cgcaagtccagcctgggtca

SEQ ID NO: 4799 - DNA, 20 bp, Artificial Sequence
  Description of Artificial Sequence: Synthetic oligonucleotide
gcaagtccagcctgggtcag

SEQ ID NO: 4800 - DNA, 20 bp, Artificial Sequence
  Description of Artificial Sequence: Synthetic oligonucleotide
caagtccagcctgggtcagt

SEQ ID NO: 4801 - DNA, 20 bp, Artificial Sequence
  Description of Artificial Sequence: Synthetic oligonucleotide
aagtccagcctgggtcagtt

SEQ ID NO: 4802 - DNA, 20 bp, Artificial Sequence
  Description of Artificial Sequence: Synthetic oligonucleotide
agtccagcctgggtcagttc

SEQ ID NO: 4803 - DNA, 20 bp, Artificial Sequence
  Description of Artificial Sequence: Synthetic oligonucleotide
gtccagcctgggtcagttcc

SEQ ID NO: 4804 - DNA, 20 bp, Artificial Sequence
  Description of Artificial Sequence: Synthetic oligonucleotide
tccagcctgggtcagttcca

SEQ ID NO: 4805 - DNA, 20 bp, Artificial Sequence
  Description of Artificial Sequence: Synthetic oligonucleotide
ccagcctgggtcagttccag

SEQ ID NO: 4806 - DNA, 20 bp, Artificial Sequence
  Description of Artificial Sequence: Synthetic oligonucleotide
cagcctgggtcagttccagc

SEQ ID NO: 4807 - DNA, 20 bp, Artificial Sequence
  Description of Artificial Sequence: Synthetic oligonucleotide
agcctgggtcagttccagcc

SEQ ID NO: 4808 - DNA, 20 bp, Artificial Sequence
  Description of Artificial Sequence: Synthetic oligonucleotide
gcctgggtcagttccagccg

SEQ ID NO: 4809 - DNA, 20 bp, Artificial Sequence
  Description of Artificial Sequence: Synthetic oligonucleotide
cctgggtcagttccagccga

SEQ ID NO: 4810 - DNA, 20 bp, Artificial Sequence
  Description of Artificial Sequence: Synthetic oligonucleotide
ctgggtcagttccagccgaa

SEQ ID NO: 4811 - DNA, 20 bp, Artificial Sequence
  Description of Artificial Sequence: Synthetic oligonucleotide
tgggtcagttccagccgaac

SEQ ID NO: 4812 - DNA, 20 bp, Artificial Sequence
  Description of Artificial Sequence: Synthetic oligonucleotide
gggtcagttccagccgaaca

SEQ ID NO: 4813 - DNA, 20 bp, Artificial Sequence
  Description of Artificial Sequence: Synthetic oligonucleotide
ggtcagttccagccgaacaa

SEQ ID NO: 4814 - DNA, 20 bp, Artificial Sequence
  Description of Artificial Sequence: Synthetic oligonucleotide
gtcagttccagccgaacaat

SEQ ID NO: 4815 - DNA, 20 bp, Artificial Sequence
  Description of Artificial Sequence: Synthetic oligonucleotide
tcagttccagccgaacaatt

SEQ ID NO: 4816 - DNA, 20 bp, Artificial Sequence
  Description of Artificial Sequence: Synthetic oligonucleotide
cagttccagccgaacaattt

SEQ ID NO: 4817 - DNA, 20 bp, Artificial Sequence
  Description of Artificial Sequence: Synthetic oligonucleotide
agttccagccgaacaatttt

SEQ ID NO: 4818 - DNA, 20 bp, Artificial Sequence
  Description of Artificial Sequence: Synthetic oligonucleotide
gttccagccgaacaattttt

SEQ ID NO: 4819 - DNA, 20 bp, Artificial Sequence
  Description of Artificial Sequence: Synthetic oligonucleotide
ttccagccgaacaatttttg

SEQ ID NO: 4820 - DNA, 20 bp, Artificial Sequence
  Description of Artificial Sequence: Synthetic oligonucleotide
tccagccgaacaatttttgt

SEQ ID NO: 4821 - DNA, 20 bp, Artificial Sequence
  Description of Artificial Sequence: Synthetic oligonucleotide
ccagccgaacaatttttgtg

SEQ ID NO: 4822 - DNA, 20 bp, Artificial Sequence
  Description of Artificial Sequence: Synthetic oligonucleotide
cagccgaacaatttttgtgt

SEQ ID NO: 4823 - DNA, 20 bp, Artificial Sequence
  Description of Artificial Sequence: Synthetic oligonucleotide
agccgaacaatttttgtgtt

SEQ ID NO: 4824 - DNA, 20 bp, Artificial Sequence
  Description of Artificial Sequence: Synthetic oligonucleotide
gccgaacaatttttgtgttt

SEQ ID NO: 4825 - DNA, 20 bp, Artificial Sequence
  Description of Artificial Sequence: Synthetic oligonucleotide
ccgaacaatttttgtgtttt

SEQ ID NO: 4826 - DNA, 20 bp, Artificial Sequence
  Description of Artificial Sequence: Synthetic oligonucleotide
cgaacaatttttgtgtttta

SEQ ID NO: 4827 - DNA, 20 bp, Artificial Sequence
  Description of Artificial Sequence: Synthetic oligonucleotide
gaacaatttttgtgttttaa

SEQ ID NO: 4828 - DNA, 20 bp, Artificial Sequence
  Description of Artificial Sequence: Synthetic oligonucleotide
aacaatttttgtgttttaaa

SEQ ID NO: 4829 - DNA, 20 bp, Artificial Sequence
  Description of Artificial Sequence: Synthetic oligonucleotide
acaatttttgtgttttaaaa

SEQ ID NO: 4830 - DNA, 20 bp, Artificial Sequence
  Description of Artificial Sequence: Synthetic oligonucleotide
caatttttgtgttttaaaaa

SEQ ID NO: 4831 - DNA, 20 bp, Artificial Sequence
  Description of Artificial Sequence: Synthetic oligonucleotide
aatttttgtgttttaaaaat

SEQ ID NO: 4832 - DNA, 20 bp, Artificial Sequence
  Description of Artificial Sequence: Synthetic oligonucleotide
atttttgtgttttaaaaata

SEQ ID NO: 4833 - DNA, 20 bp, Artificial Sequence
  Description of Artificial Sequence: Synthetic oligonucleotide
tttttgtgttttaaaaataa

SEQ ID NO: 4834 - DNA, 20 bp, Artificial Sequence
  Description of Artificial Sequence: Synthetic oligonucleotide
ttttgtgttttaaaaataat

SEQ ID NO: 4835 - DNA, 20 bp, Artificial Sequence
  Description of Artificial Sequence: Synthetic oligonucleotide
tttgtgttttaaaaataatg

SEQ ID NO: 4836 - DNA, 20 bp, Artificial Sequence
  Description of Artificial Sequence: Synthetic oligonucleotide
ttgtgttttaaaaataatgt

SEQ ID NO: 4837 - DNA, 20 bp, Artificial Sequence
  Description of Artificial Sequence: Synthetic oligonucleotide
tgtgttttaaaaataatgtg

SEQ ID NO: 4838 - DNA, 20 bp, Artificial Sequence
  Description of Artificial Sequence: Synthetic oligonucleotide
gtgttttaaaaataatgtgt

SEQ ID NO: 4839 - DNA, 20 bp, Artificial Sequence
  Description of Artificial Sequence: Synthetic oligonucleotide
tgttttaaaaataatgtgta

SEQ ID NO: 4840 - DNA, 20 bp, Artificial Sequence
  Description of Artificial Sequence: Synthetic oligonucleotide
gttttaaaaataatgtgtag

SEQ ID NO: 4841 - DNA, 20 bp, Artificial Sequence
  Description of Artificial Sequence: Synthetic oligonucleotide
ttttaaaaataatgtgtaga

SEQ ID NO: 4842 - DNA, 20 bp, Artificial Sequence
  Description of Artificial Sequence: Synthetic oligonucleotide
tttaaaaataatgtgtagac

SEQ ID NO: 4843 - DNA, 20 bp, Artificial Sequence
  Description of Artificial Sequence: Synthetic oligonucleotide
ttaaaaataatgtgtagact

SEQ ID NO: 4844 - DNA, 20 bp, Artificial Sequence
  Description of Artificial Sequence: Synthetic oligonucleotide
taaaaataatgtgtagactc

SEQ ID NO: 4845 - DNA, 20 bp, Artificial Sequence
  Description of Artificial Sequence: Synthetic oligonucleotide
aaaaataatgtgtagactca

SEQ ID NO: 4846 - DNA, 20 bp, Artificial Sequence
  Description of Artificial Sequence: Synthetic oligonucleotide
aaaataatgtgtagactcaa

SEQ ID NO: 4847 - DNA, 20 bp, Artificial Sequence
  Description of Artificial Sequence: Synthetic oligonucleotide
aaataatgtgtagactcaag

SEQ ID NO: 4848 - DNA, 20 bp, Artificial Sequence
  Description of Artificial Sequence: Synthetic oligonucleotide
aataatgtgtagactcaaga

SEQ ID NO: 4849 - DNA, 20 bp, Artificial Sequence
  Description of Artificial Sequence: Synthetic oligonucleotide
ataatgtgtagactcaagat

SEQ ID NO: 4850 - DNA, 20 bp, Artificial Sequence
  Description of Artificial Sequence: Synthetic oligonucleotide
taatgtgtagactcaagata

SEQ ID NO: 4851 - DNA, 20 bp, Artificial Sequence
  Description of Artificial Sequence: Synthetic oligonucleotide
aatgtgtagactcaagataa

SEQ ID NO: 4852 - DNA, 20 bp, Artificial Sequence
  Description of Artificial Sequence: Synthetic oligonucleotide
atgtgtagactcaagataat

SEQ ID NO: 4853 - DNA, 20 bp, Artificial Sequence
  Description of Artificial Sequence: Synthetic oligonucleotide
tgtgtagactcaagataatt

SEQ ID NO: 4854 - DNA, 20 bp, Artificial Sequence
  Description of Artificial Sequence: Synthetic oligonucleotide
gtgtagactcaagataattt

SEQ ID NO: 4855 - DNA, 20 bp, Artificial Sequence
  Description of Artificial Sequence: Synthetic oligonucleotide
tgtagactcaagataatttc

SEQ ID NO: 4856 - DNA, 20 bp, Artificial Sequence
  Description of Artificial Sequence: Synthetic oligonucleotide
gtagactcaagataatttca

SEQ ID NO: 4857 - DNA, 20 bp, Artificial Sequence
  Description of Artificial Sequence: Synthetic oligonucleotide
tagactcaagataatttcac

SEQ ID NO: 4858 - DNA, 20 bp, Artificial Sequence
  Description of Artificial Sequence: Synthetic oligonucleotide
agactcaagataatttcact

SEQ ID NO: 4859 - DNA, 20 bp, Artificial Sequence
  Description of Artificial Sequence: Synthetic oligonucleotide
gactcaagataatttcactg

SEQ ID NO: 4860 - DNA, 20 bp, Artificial Sequence
  Description of Artificial Sequence: Synthetic oligonucleotide
actcaagataatttcactgg

SEQ ID NO: 4861 - DNA, 20 bp, Artificial Sequence
  Description of Artificial Sequence: Synthetic oligonucleotide
ctcaagataatttcactgga

SEQ ID NO: 4862 - DNA, 20 bp, Artificial Sequence
  Description of Artificial Sequence: Synthetic oligonucleotide
tcaagataatttcactggat

SEQ ID NO: 4863 - DNA, 20 bp, Artificial Sequence
  Description of Artificial Sequence: Synthetic oligonucleotide
caagataatttcactggatt

SEQ ID NO: 4864 - DNA, 20 bp, Artificial Sequence
  Description of Artificial Sequence: Synthetic oligonucleotide
aagataatttcactggattt

SEQ ID NO: 4865 - DNA, 20 bp, Artificial Sequence
  Description of Artificial Sequence: Synthetic oligonucleotide
agataatttcactggattta

SEQ ID NO: 4866 - DNA, 20 bp, Artificial Sequence
  Description of Artificial Sequence: Synthetic oligonucleotide
gataatttcactggatttaa

SEQ ID NO: 4867 - DNA, 20 bp, Artificial Sequence
  Description of Artificial Sequence: Synthetic oligonucleotide
ataatttcactggatttaaa

SEQ ID NO: 4868 - DNA, 20 bp, Artificial Sequence
  Description of Artificial Sequence: Synthetic oligonucleotide
taatttcactggatttaaaa

SEQ ID NO: 4869 - DNA, 20 bp, Artificial Sequence
  Description of Artificial Sequence: Synthetic oligonucleotide
aatttcactggatttaaaaa

SEQ ID NO: 4870 - DNA, 20 bp, Artificial Sequence
  Description of Artificial Sequence: Synthetic oligonucleotide
atttcactggatttaaaaat

SEQ ID NO: 4871 - DNA, 20 bp, Artificial Sequence
  Description of Artificial Sequence: Synthetic oligonucleotide
tttcactggatttaaaaata

SEQ ID NO: 4872 - DNA, 20 bp, Artificial Sequence
  Description of Artificial Sequence: Synthetic oligonucleotide
ttcactggatttaaaaatag

SEQ ID NO: 4873 - DNA, 20 bp, Artificial Sequence
  Description of Artificial Sequence: Synthetic oligonucleotide
tcactggatttaaaaataga

SEQ ID NO: 4874 - DNA, 20 bp, Artificial Sequence
  Description of Artificial Sequence: Synthetic oligonucleotide
cactggatttaaaaatagaa

SEQ ID NO: 4875 - DNA, 20 bp, Artificial Sequence
  Description of Artificial Sequence: Synthetic oligonucleotide
actggatttaaaaatagaaa

SEQ ID NO: 4876 - DNA, 20 bp, Artificial Sequence
  Description of Artificial Sequence: Synthetic oligonucleotide
ctggatttaaaaatagaaat

SEQ ID NO: 4877 - DNA, 20 bp, Artificial Sequence
  Description of Artificial Sequence: Synthetic oligonucleotide
tggatttaaaaatagaaata

SEQ ID NO: 4878 - DNA, 20 bp, Artificial Sequence
  Description of Artificial Sequence: Synthetic oligonucleotide
ggatttaaaaatagaaatac

SEQ ID NO: 4879 - DNA, 20 bp, Artificial Sequence
  Description of Artificial Sequence: Synthetic oligonucleotide
gatttaaaaatagaaatacc

SEQ ID NO: 4880 - DNA, 20 bp, Artificial Sequence
  Description of Artificial Sequence: Synthetic oligonucleotide
atttaaaaatagaaatacca

SEQ ID NO: 4881 - DNA, 20 bp, Artificial Sequence
  Description of Artificial Sequence: Synthetic oligonucleotide
tttaaaaatagaaataccat

SEQ ID NO: 4882 - DNA, 20 bp, Artificial Sequence
  Description of Artificial Sequence: Synthetic oligonucleotide
ttaaaaatagaaataccatt

SEQ ID NO: 4883 - DNA, 20 bp, Artificial Sequence
  Description of Artificial Sequence: Synthetic oligonucleotide
taaaaatagaaataccattt

SEQ ID NO: 4884 - DNA, 20 bp, Artificial Sequence
  Description of Artificial Sequence: Synthetic oligonucleotide
aaaaatagaaataccatttc

SEQ ID NO: 4885 - DNA, 20 bp, Artificial Sequence
  Description of Artificial Sequence: Synthetic oligonucleotide
aaaatagaaataccatttcc

SEQ ID NO: 4886 - DNA, 20 bp, Artificial Sequence
  Description of Artificial Sequence: Synthetic oligonucleotide
aaatagaaataccatttccc

SEQ ID NO: 4887 - DNA, 20 bp, Artificial Sequence
  Description of Artificial Sequence: Synthetic oligonucleotide
aatagaaataccatttccca

SEQ ID NO: 4888 - DNA, 20 bp, Artificial Sequence
  Description of Artificial Sequence: Synthetic oligonucleotide
atagaaataccatttcccac

SEQ ID NO: 4889 - DNA, 20 bp, Artificial Sequence
  Description of Artificial Sequence: Synthetic oligonucleotide
tagaaataccatttcccacc

SEQ ID NO: 4890 - DNA, 20 bp, Artificial Sequence
  Description of Artificial Sequence: Synthetic oligonucleotide
agaaataccatttcccacct

SEQ ID NO: 4891 - DNA, 20 bp, Artificial Sequence
  Description of Artificial Sequence: Synthetic oligonucleotide
gaaataccatttcccacctg

SEQ ID NO: 4892 - DNA, 20 bp, Artificial Sequence
  Description of Artificial Sequence: Synthetic oligonucleotide
aaataccatttcccacctgc

SEQ ID NO: 4893 - DNA, 20 bp, Artificial Sequence
  Description of Artificial Sequence: Synthetic oligonucleotide
aataccatttcccacctgcc

SEQ ID NO: 4894 - DNA, 20 bp, Artificial Sequence
  Description of Artificial Sequence: Synthetic oligonucleotide
ataccatttcccacctgcct

SEQ ID NO: 4895 - DNA, 20 bp, Artificial Sequence
  Description of Artificial Sequence: Synthetic oligonucleotide
taccatttcccacctgcctc

SEQ ID NO: 4896 - DNA, 20 bp, Artificial Sequence
  Description of Artificial Sequence: Synthetic oligonucleotide
accatttcccacctgcctcc

SEQ ID NO: 4897 - DNA, 20 bp, Artificial Sequence
  Description of Artificial Sequence: Synthetic oligonucleotide
ccatttcccacctgcctcct

SEQ ID NO: 4898 - DNA, 20 bp, Artificial Sequence
  Description of Artificial Sequence: Synthetic oligonucleotide
catttcccacctgcctcctt

SEQ ID NO: 4899 - DNA, 20 bp, Artificial Sequence
  Description of Artificial Sequence: Synthetic oligonucleotide
atttcccacctgcctccttc

SEQ ID NO: 4900 - DNA, 20 bp, Artificial Sequence
  Description of Artificial Sequence: Synthetic oligonucleotide
tttcccacctgcctccttca

SEQ ID NO: 4901 - DNA, 20 bp, Artificial Sequence
  Description of Artificial Sequence: Synthetic oligonucleotide
ttcccacctgcctccttcac

SEQ ID NO: 4902 - DNA, 20 bp, Artificial Sequence
  Description of Artificial Sequence: Synthetic oligonucleotide
tcccacctgcctccttcact

SEQ ID NO: 4903 - DNA, 20 bp, Artificial Sequence
  Description of Artificial Sequence: Synthetic oligonucleotide
cccacctgcctccttcactc

SEQ ID NO: 4904 - DNA, 20 bp, Artificial Sequence
  Description of Artificial Sequence: Synthetic oligonucleotide
ccacctgcctccttcactcc

SEQ ID NO: 4905 - DNA, 20 bp, Artificial Sequence
  Description of Artificial Sequence: Synthetic oligonucleotide
cacctgcctccttcactcct

SEQ ID NO: 4906 - DNA, 20 bp, Artificial Sequence
  Description of Artificial Sequence: Synthetic oligonucleotide
acctgcctccttcactcctt

SEQ ID NO: 4907 - DNA, 20 bp, Artificial Sequence
  Description of Artificial Sequence: Synthetic oligonucleotide
cctgcctccttcactccttt

SEQ ID NO: 4908 - DNA, 20 bp, Artificial Sequence
  Description of Artificial Sequence: Synthetic oligonucleotide
ctgcctccttcactcctttc

SEQ ID NO: 4909 - DNA, 20 bp, Artificial Sequence
  Description of Artificial Sequence: Synthetic oligonucleotide
tgcctccttcactcctttct

SEQ ID NO: 4910 - DNA, 20 bp, Artificial Sequence
  Description of Artificial Sequence: Synthetic oligonucleotide
gcctccttcactcctttctc

SEQ ID NO: 4911 - DNA, 20 bp, Artificial Sequence
  Description of Artificial Sequence: Synthetic oligonucleotide
cctccttcactcctttctct

SEQ ID NO: 4912 - DNA, 20 bp, Artificial Sequence
  Description of Artificial Sequence: Synthetic oligonucleotide
ctccttcactcctttctcta

SEQ ID NO: 4913 - DNA, 20 bp, Artificial Sequence
  Description of Artificial Sequence: Synthetic oligonucleotide
tccttcactcctttctctaa

SEQ ID NO: 4914 - DNA, 20 bp, Artificial Sequence
  Description of Artificial Sequence: Synthetic oligonucleotide
ccttcactcctttctctaac

SEQ ID NO: 4915 - DNA, 20 bp, Artificial Sequence
  Description of Artificial Sequence: Synthetic oligonucleotide
cttcactcctttctctaaca

SEQ ID NO: 4916 - DNA, 20 bp, Artificial Sequence
  Description of Artificial Sequence: Synthetic oligonucleotide
ttcactcctttctctaacac

SEQ ID NO: 4917 - DNA, 20 bp, Artificial Sequence
  Description of Artificial Sequence: Synthetic oligonucleotide
tcactcctttctctaacact

SEQ ID NO: 4918 - DNA, 20 bp, Artificial Sequence
  Description of Artificial Sequence: Synthetic oligonucleotide
cactcctttctctaacactc

SEQ ID NO: 4919 - DNA, 20 bp, Artificial Sequence
  Description of Artificial Sequence: Synthetic oligonucleotide
actcctttctctaacactca

SEQ ID NO: 4920 - DNA, 20 bp, Artificial Sequence
  Description of Artificial Sequence: Synthetic oligonucleotide
ctcctttctctaacactcaa

SEQ ID NO: 4921 - DNA, 20 bp, Artificial Sequence
  Description of Artificial Sequence: Synthetic oligonucleotide
tcctttctctaacactcaaa

SEQ ID NO: 4922 - DNA, 20 bp, Artificial Sequence
  Description of Artificial Sequence: Synthetic oligonucleotide
cctttctctaacactcaaag

SEQ ID NO: 4923 - DNA, 20 bp, Artificial Sequence
  Description of Artificial Sequence: Synthetic oligonucleotide
ctttctctaacactcaaagg

SEQ ID NO: 4924 - DNA, 20 bp, Artificial Sequence
  Description of Artificial Sequence: Synthetic oligonucleotide
tttctctaacactcaaaggc

SEQ ID NO: 4925 - DNA, 20 bp, Artificial Sequence
  Description of Artificial Sequence: Synthetic oligonucleotide
ttctctaacactcaaaggcc

SEQ ID NO: 4926 - DNA, 20 bp, Artificial Sequence
  Description of Artificial Sequence: Synthetic oligonucleotide
tctctaacactcaaaggcct

SEQ ID NO: 4927 - DNA, 20 bp, Artificial Sequence
  Description of Artificial Sequence: Synthetic oligonucleotide
ctctaacactcaaaggccta

SEQ ID NO: 4928 - DNA, 20 bp, Artificial Sequence
  Description of Artificial Sequence: Synthetic oligonucleotide
tctaacactcaaaggcctat

SEQ ID NO: 4929 - DNA, 20 bp, Artificial Sequence
  Description of Artificial Sequence: Synthetic oligonucleotide
ctaacactcaaaggcctatc

SEQ ID NO: 4930 - DNA, 20 bp, Artificial Sequence
  Description of Artificial Sequence: Synthetic oligonucleotide
taacactcaaaggcctatcc

SEQ ID NO: 4931 - DNA, 20 bp, Artificial Sequence
  Description of Artificial Sequence: Synthetic oligonucleotide
aacactcaaaggcctatcct

SEQ ID NO: 4932 - DNA, 20 bp, Artificial Sequence
  Description of Artificial Sequence: Synthetic oligonucleotide
acactcaaaggcctatcctt

SEQ ID NO: 4933 - DNA, 20 bp, Artificial Sequence
  Description of Artificial Sequence: Synthetic oligonucleotide
cactcaaaggcctatccttt

SEQ ID NO: 4934 - DNA, 20 bp, Artificial Sequence
  Description of Artificial Sequence: Synthetic oligonucleotide
actcaaaggcctatcctttg

SEQ ID NO: 4935 - DNA, 20 bp, Artificial Sequence
  Description of Artificial Sequence: Synthetic oligonucleotide
ctcaaaggcctatcctttga

SEQ ID NO: 4936 - DNA, 20 bp, Artificial Sequence
  Description of Artificial Sequence: Synthetic oligonucleotide
tcaaaggcctatcctttgag

SEQ ID NO: 4937 - DNA, 20 bp, Artificial Sequence
  Description of Artificial Sequence: Synthetic oligonucleotide
caaaggcctatcctttgaga

SEQ ID NO: 4938 - DNA, 20 bp, Artificial Sequence
  Description of Artificial Sequence: Synthetic oligonucleotide
aaaggcctatcctttgagaa

SEQ ID NO: 4939 - DNA, 20 bp, Artificial Sequence
  Description of Artificial Sequence: Synthetic oligonucleotide
aaggcctatcctttgagaat

SEQ ID NO: 4940 - DNA, 20 bp, Artificial Sequence
  Description of Artificial Sequence: Synthetic oligonucleotide
aggcctatcctttgagaatc

SEQ ID NO: 4941 - DNA, 20 bp, Artificial Sequence
  Description of Artificial Sequence: Synthetic oligonucleotide
ggcctatcctttgagaatca

SEQ ID NO: 4942 - DNA, 20 bp, Artificial Sequence
  Description of Artificial Sequence: Synthetic oligonucleotide
gcctatcctttgagaatcaa

SEQ ID NO: 4943 - DNA, 20 bp, Artificial Sequence
  Description of Artificial Sequence: Synthetic oligonucleotide
cctatcctttgagaatcaaa

SEQ ID NO: 4944 - DNA, 20 bp, Artificial Sequence
  Description of Artificial Sequence: Synthetic oligonucleotide
ctatcctttgagaatcaaaa

SEQ ID NO: 4945 - DNA, 20 bp, Artificial Sequence
  Description of Artificial Sequence: Synthetic oligonucleotide
tatcctttgagaatcaaaat

SEQ ID NO: 4946 - DNA, 20 bp, Artificial Sequence
  Description of Artificial Sequence: Synthetic oligonucleotide
atcctttgagaatcaaaata

SEQ ID NO: 4947 - DNA, 20 bp, Artificial Sequence
  Description of Artificial Sequence: Synthetic oligonucleotide
tcctttgagaatcaaaataa

SEQ ID NO: 4948 - DNA, 20 bp, Artificial Sequence
  Description of Artificial Sequence: Synthetic oligonucleotide
cctttgagaatcaaaataat

SEQ ID NO: 4949 - DNA, 20 bp, Artificial Sequence
  Description of Artificial Sequence: Synthetic oligonucleotide
ctttgagaatcaaaataata

SEQ ID NO: 4950 - DNA, 20 bp, Artificial Sequence
  Description of Artificial Sequence: Synthetic oligonucleotide
tttgagaatcaaaataatat

SEQ ID NO: 4951 - DNA, 20 bp, Artificial Sequence
  Description of Artificial Sequence: Synthetic oligonucleotide
ttgagaatcaaaataatatg

SEQ ID NO: 4952 - DNA, 20 bp, Artificial Sequence
  Description of Artificial Sequence: Synthetic oligonucleotide
tgagaatcaaaataatatgg

SEQ ID NO: 4953 - DNA, 20 bp, Artificial Sequence
  Description of Artificial Sequence: Synthetic oligonucleotide
gagaatcaaaataatatggt

SEQ ID NO: 4954 - DNA, 20 bp, Artificial Sequence
  Description of Artificial Sequence: Synthetic oligonucleotide
agaatcaaaataatatggtt

SEQ ID NO: 4955 - DNA, 20 bp, Artificial Sequence
  Description of Artificial Sequence: Synthetic oligonucleotide
gaatcaaaataatatggttc

SEQ ID NO: 4956 - DNA, 20 bp, Artificial Sequence
  Description of Artificial Sequence: Synthetic oligonucleotide
aatcaaaataatatggttct

SEQ ID NO: 4957 - DNA, 20 bp, Artificial Sequence
  Description of Artificial Sequence: Synthetic oligonucleotide
atcaaaataatatggttctt

SEQ ID NO: 4958 - DNA, 20 bp, Artificial Sequence
  Description of Artificial Sequence: Synthetic oligonucleotide
tcaaaataatatggttcttt

SEQ ID NO: 4959 - DNA, 20 bp, Artificial Sequence
  Description of Artificial Sequence: Synthetic oligonucleotide
caaaataatatggttctttt

SEQ ID NO: 4960 - DNA, 20 bp, Artificial Sequence
  Description of Artificial Sequence: Synthetic oligonucleotide
aaaataatatggttcttttt

SEQ ID NO: 4961 - DNA, 20 bp, Artificial Sequence
  Description of Artificial Sequence: Synthetic oligonucleotide
aaataatatggttcttttta

SEQ ID NO: 4962 - DNA, 20 bp, Artificial Sequence
  Description of Artificial Sequence: Synthetic oligonucleotide
aataatatggttctttttag

SEQ ID NO: 4963 - DNA, 20 bp, Artificial Sequence
  Description of Artificial Sequence: Synthetic oligonucleotide
ataatatggttctttttagc

SEQ ID NO: 4964 - DNA, 20 bp, Artificial Sequence
  Description of Artificial Sequence: Synthetic oligonucleotide
taatatggttctttttagca

SEQ ID NO: 4965 - DNA, 20 bp, Artificial Sequence
  Description of Artificial Sequence: Synthetic oligonucleotide
aatatggttctttttagcaa

SEQ ID NO: 4966 - DNA, 20 bp, Artificial Sequence
  Description of Artificial Sequence: Synthetic oligonucleotide
atatggttctttttagcaaa

SEQ ID NO: 4967 - DNA, 20 bp, Artificial Sequence
  Description of Artificial Sequence: Synthetic oligonucleotide
tatggttctttttagcaaag

SEQ ID NO: 4968 - DNA, 20 bp, Artificial Sequence
  Description of Artificial Sequence: Synthetic oligonucleotide
atggttctttttagcaaagg

SEQ ID NO: 4969 - DNA, 20 bp, Artificial Sequence
  Description of Artificial Sequence: Synthetic oligonucleotide
tggttctttttagcaaaggg

SEQ ID NO: 4970 - DNA, 20 bp, Artificial Sequence
  Description of Artificial Sequence: Synthetic oligonucleotide
ggttctttttagcaaaggga

SEQ ID NO: 4971 - DNA, 20 bp, Artificial Sequence
  Description of Artificial Sequence: Synthetic oligonucleotide
gttctttttagcaaagggat

SEQ ID NO: 4972 - DNA, 20 bp, Artificial Sequence
  Description of Artificial Sequence: Synthetic oligonucleotide
ttctttttagcaaagggatt

SEQ ID NO: 4973 - DNA, 20 bp, Artificial Sequence
  Description of Artificial Sequence: Synthetic oligonucleotide
tctttttagcaaagggattt

SEQ ID NO: 4974 - DNA, 20 bp, Artificial Sequence
  Description of Artificial Sequence: Synthetic oligonucleotide
ctttttagcaaagggatttg

SEQ ID NO: 4975 - DNA, 20 bp, Artificial Sequence
  Description of Artificial Sequence: Synthetic oligonucleotide
tttttagcaaagggatttgt

SEQ ID NO: 4976 - DNA, 20 bp, Artificial Sequence
  Description of Artificial Sequence: Synthetic oligonucleotide
ttttagcaaagggatttgtg

SEQ ID NO: 4977 - DNA, 20 bp, Artificial Sequence
  Description of Artificial Sequence: Synthetic oligonucleotide
tttagcaaagggatttgtgt

SEQ ID NO: 4978 - DNA, 20 bp, Artificial Sequence
  Description of Artificial Sequence: Synthetic oligonucleotide
ttagcaaagggatttgtgtt

SEQ ID NO: 4979 - DNA, 20 bp, Artificial Sequence
  Description of Artificial Sequence: Synthetic oligonucleotide
tagcaaagggatttgtgttt

SEQ ID NO: 4980 - DNA, 20 bp, Artificial Sequence
  Description of Artificial Sequence: Synthetic oligonucleotide
agcaaagggatttgtgtttt

SEQ ID NO: 4981 - DNA, 20 bp, Artificial Sequence
  Description of Artificial Sequence: Synthetic oligonucleotide
gcaaagggatttgtgttttg

SEQ ID NO: 4982 - DNA, 20 bp, Artificial Sequence
  Description of Artificial Sequence: Synthetic oligonucleotide
caaagggatttgtgttttgc

SEQ ID NO: 4983 - DNA, 20 bp, Artificial Sequence
  Description of Artificial Sequence: Synthetic oligonucleotide
aaagggatttgtgttttgcc

SEQ ID NO: 4984 - DNA, 20 bp, Artificial Sequence
  Description of Artificial Sequence: Synthetic oligonucleotide
aagggatttgtgttttgccc

SEQ ID NO: 4985 - DNA, 20 bp, Artificial Sequence
  Description of Artificial Sequence: Synthetic oligonucleotide
agggatttgtgttttgccct

SEQ ID NO: 4986 - DNA, 20 bp, Artificial Sequence
  Description of Artificial Sequence: Synthetic oligonucleotide
gggatttgtgttttgccctc

SEQ ID NO: 4987 - DNA, 20 bp, Artificial Sequence
  Description of Artificial Sequence: Synthetic oligonucleotide
ggatttgtgttttgccctca

SEQ ID NO: 4988 - DNA, 20 bp, Artificial Sequence
  Description of Artificial Sequence: Synthetic oligonucleotide
gatttgtgttttgccctcac

SEQ ID NO: 4989 - DNA, 20 bp, Artificial Sequence
  Description of Artificial Sequence: Synthetic oligonucleotide
atttgtgttttgccctcaca

SEQ ID NO: 4990 - DNA, 20 bp, Artificial Sequence
  Description of Artificial Sequence: Synthetic oligonucleotide
tttgtgttttgccctcacat

SEQ ID NO: 4991 - DNA, 20 bp, Artificial Sequence
  Description of Artificial Sequence: Synthetic oligonucleotide
ttgtgttttgccctcacata

SEQ ID NO: 4992 - DNA, 20 bp, Artificial Sequence
  Description of Artificial Sequence: Synthetic oligonucleotide
tgtgttttgccctcacatag

SEQ ID NO: 4993 - DNA, 20 bp, Artificial Sequence
  Description of Artificial Sequence: Synthetic oligonucleotide
gtgttttgccctcacatagc

SEQ ID NO: 4994 - DNA, 20 bp, Artificial Sequence
  Description of Artificial Sequence: Synthetic oligonucleotide
tgttttgccctcacatagcc

SEQ ID NO: 4995 - DNA, 20 bp, Artificial Sequence
  Description of Artificial Sequence: Synthetic oligonucleotide
gttttgccctcacatagcct

SEQ ID NO: 4996 - DNA, 20 bp, Artificial Sequence
  Description of Artificial Sequence: Synthetic oligonucleotide
ttttgccctcacatagccta

SEQ ID NO: 4997 - DNA, 20 bp, Artificial Sequence
  Description of Artificial Sequence: Synthetic oligonucleotide
tttgccctcacatagcctaa

SEQ ID NO: 4998 - DNA, 20 bp, Artificial Sequence
  Description of Artificial Sequence: Synthetic oligonucleotide
ttgccctcacatagcctaag

SEQ ID NO: 4999 - DNA, 20 bp, Artificial Sequence
  Description of Artificial Sequence: Synthetic oligonucleotide
tgccctcacatagcctaagc

SEQ ID NO: 5000 - DNA, 20 bp, Artificial Sequence
  Description of Artificial Sequence: Synthetic oligonucleotide
gccctcacatagcctaagcc

SEQ ID NO: 5001 - DNA, 20 bp, Artificial Sequence
  Description of Artificial Sequence: Synthetic oligonucleotide
ccctcacatagcctaagccg

SEQ ID NO: 5002 - DNA, 20 bp, Artificial Sequence
  Description of Artificial Sequence: Synthetic oligonucleotide
cctcacatagcctaagccgt

SEQ ID NO: 5003 - DNA, 20 bp, Artificial Sequence
  Description of Artificial Sequence: Synthetic oligonucleotide
ctcacatagcctaagccgta

SEQ ID NO: 5004 - DNA, 20 bp, Artificial Sequence
  Description of Artificial Sequence: Synthetic oligonucleotide
tcacatagcctaagccgtag

SEQ ID NO: 5005 - DNA, 20 bp, Artificial Sequence
  Description of Artificial Sequence: Synthetic oligonucleotide
cacatagcctaagccgtaga

SEQ ID NO: 5006 - DNA, 20 bp, Artificial Sequence
  Description of Artificial Sequence: Synthetic oligonucleotide
acatagcctaagccgtagag

SEQ ID NO: 5007 - DNA, 20 bp, Artificial Sequence
  Description of Artificial Sequence: Synthetic oligonucleotide
catagcctaagccgtagaga

SEQ ID NO: 5008 - DNA, 20 bp, Artificial Sequence
  Description of Artificial Sequence: Synthetic oligonucleotide
atagcctaagccgtagagaa

SEQ ID NO: 5009 - DNA, 20 bp, Artificial Sequence
  Description of Artificial Sequence: Synthetic oligonucleotide
tagcctaagccgtagagaaa

SEQ ID NO: 5010 - DNA, 20 bp, Artificial Sequence
  Description of Artificial Sequence: Synthetic oligonucleotide
agcctaagccgtagagaaaa

SEQ ID NO: 5011 - DNA, 20 bp, Artificial Sequence
  Description of Artificial Sequence: Synthetic oligonucleotide
gcctaagccgtagagaaaat

SEQ ID NO: 5012 - DNA, 20 bp, Artificial Sequence
  Description of Artificial Sequence: Synthetic oligonucleotide
cctaagccgtagagaaaata

SEQ ID NO: 5013 - DNA, 20 bp, Artificial Sequence
  Description of Artificial Sequence: Synthetic oligonucleotide
ctaagccgtagagaaaatag

SEQ ID NO: 5014 - DNA, 20 bp, Artificial Sequence
  Description of Artificial Sequence: Synthetic oligonucleotide
taagccgtagagaaaataga

SEQ ID NO: 5015 - DNA, 20 bp, Artificial Sequence
  Description of Artificial Sequence: Synthetic oligonucleotide
aagccgtagagaaaatagat

SEQ ID NO: 5016 - DNA, 20 bp, Artificial Sequence
  Description of Artificial Sequence: Synthetic oligonucleotide
agccgtagagaaaatagata

SEQ ID NO: 5017 - DNA, 20 bp, Artificial Sequence
  Description of Artificial Sequence: Synthetic oligonucleotide
gccgtagagaaaatagataa

SEQ ID NO: 5018 - DNA, 20 bp, Artificial Sequence
  Description of Artificial Sequence: Synthetic oligonucleotide
ccgtagagaaaatagataaa

SEQ ID NO: 5019 - DNA, 20 bp, Artificial Sequence
  Description of Artificial Sequence: Synthetic oligonucleotide
cgtagagaaaatagataaaa

SEQ ID NO: 5020 - DNA, 20 bp, Artificial Sequence
  Description of Artificial Sequence: Synthetic oligonucleotide
gtagagaaaatagataaaac

SEQ ID NO: 5021 - DNA, 20 bp, Artificial Sequence
  Description of Artificial Sequence: Synthetic oligonucleotide
tagagaaaatagataaaacg

SEQ ID NO: 5022 - DNA, 20 bp, Artificial Sequence
  Description of Artificial Sequence: Synthetic oligonucleotide
agagaaaatagataaaacga

SEQ ID NO: 5023 - DNA, 20 bp, Artificial Sequence
  Description of Artificial Sequence: Synthetic oligonucleotide
gagaaaatagataaaacgat

SEQ ID NO: 5024 - DNA, 20 bp, Artificial Sequence
  Description of Artificial Sequence: Synthetic oligonucleotide
agaaaatagataaaacgatc

SEQ ID NO: 5025 - DNA, 20 bp, Artificial Sequence
  Description of Artificial Sequence: Synthetic oligonucleotide
gaaaatagataaaacgatct

SEQ ID NO: 5026 - DNA, 20 bp, Artificial Sequence
  Description of Artificial Sequence: Synthetic oligonucleotide
aaaatagataaaacgatctc

SEQ ID NO: 5027 - DNA, 20 bp, Artificial Sequence
  Description of Artificial Sequence: Synthetic oligonucleotide
aaatagataaaacgatctca

SEQ ID NO: 5028 - DNA, 20 bp, Artificial Sequence
  Description of Artificial Sequence: Synthetic oligonucleotide
aatagataaaacgatctcaa

SEQ ID NO: 5029 - DNA, 20 bp, Artificial Sequence
  Description of Artificial Sequence: Synthetic oligonucleotide
atagataaaacgatctcaaa

SEQ ID NO: 5030 - DNA, 20 bp, Artificial Sequence
  Description of Artificial Sequence: Synthetic oligonucleotide
tagataaaacgatctcaaaa

SEQ ID NO: 5031 - DNA, 20 bp, Artificial Sequence
  Description of Artificial Sequence: Synthetic oligonucleotide
agataaaacgatctcaaaat

SEQ ID NO: 5032 - DNA, 20 bp, Artificial Sequence
  Description of Artificial Sequence: Synthetic oligonucleotide
gataaaacgatctcaaaatt

SEQ ID NO: 5033 - DNA, 20 bp, Artificial Sequence
  Description of Artificial Sequence: Synthetic oligonucleotide
ataaaacgatctcaaaatta

SEQ ID NO: 5034 - DNA, 20 bp, Artificial Sequence
  Description of Artificial Sequence: Synthetic oligonucleotide
taaaacgatctcaaaattat

SEQ ID NO: 5035 - DNA, 20 bp, Artificial Sequence
  Description of Artificial Sequence: Synthetic oligonucleotide
aaaacgatctcaaaattatt

SEQ ID NO: 5036 - DNA, 20 bp, Artificial Sequence
  Description of Artificial Sequence: Synthetic oligonucleotide
aaacgatctcaaaattattt

SEQ ID NO: 5037 - DNA, 20 bp, Artificial Sequence
  Description of Artificial Sequence: Synthetic oligonucleotide
aacgatctcaaaattatttt

SEQ ID NO: 5038 - DNA, 20 bp, Artificial Sequence
  Description of Artificial Sequence: Synthetic oligonucleotide
acgatctcaaaattattttc

SEQ ID NO: 5039 - DNA, 20 bp, Artificial Sequence
  Description of Artificial Sequence: Synthetic oligonucleotide
cgatctcaaaattattttct

SEQ ID NO: 5040 - DNA, 20 bp, Artificial Sequence
  Description of Artificial Sequence: Synthetic oligonucleotide
gatctcaaaattattttctt

SEQ ID NO: 5041 - DNA, 20 bp, Artificial Sequence
  Description of Artificial Sequence: Synthetic oligonucleotide
atctcaaaattattttcttt

SEQ ID NO: 5042 - DNA, 20 bp, Artificial Sequence
  Description of Artificial Sequence: Synthetic oligonucleotide
tctcaaaattattttctttc

SEQ ID NO: 5043 - DNA, 20 bp, Artificial Sequence
  Description of Artificial Sequence: Synthetic oligonucleotide
ctcaaaattattttctttca

SEQ ID NO: 5044 - DNA, 20 bp, Artificial Sequence
  Description of Artificial Sequence: Synthetic oligonucleotide
tcaaaattattttctttcac

SEQ ID NO: 5045 - DNA, 20 bp, Artificial Sequence
  Description of Artificial Sequence: Synthetic oligonucleotide
caaaattattttctttcaca

SEQ ID NO: 5046 - DNA, 20 bp, Artificial Sequence
  Description of Artificial Sequence: Synthetic oligonucleotide
aaaattattttctttcacag

SEQ ID NO: 5047 - DNA, 20 bp, Artificial Sequence
  Description of Artificial Sequence: Synthetic oligonucleotide
aaattattttctttcacaga

SEQ ID NO: 5048 - DNA, 20 bp, Artificial Sequence
  Description of Artificial Sequence: Synthetic oligonucleotide
aattattttctttcacagac

SEQ ID NO: 5049 - DNA, 20 bp, Artificial Sequence
  Description of Artificial Sequence: Synthetic oligonucleotide
attattttctttcacagaca

SEQ ID NO: 5050 - DNA, 20 bp, Artificial Sequence
  Description of Artificial Sequence: Synthetic oligonucleotide
ttattttctttcacagacaa

SEQ ID NO: 5051 - DNA, 20 bp, Artificial Sequence
  Description of Artificial Sequence: Synthetic oligonucleotide
tattttctttcacagacaaa

SEQ ID NO: 5052 - DNA, 20 bp, Artificial Sequence
  Description of Artificial Sequence: Synthetic oligonucleotide
attttctttcacagacaaat

SEQ ID NO: 5053 - DNA, 20 bp, Artificial Sequence
  Description of Artificial Sequence: Synthetic oligonucleotide
ttttctttcacagacaaatc

SEQ ID NO: 5054 - DNA, 20 bp, Artificial Sequence
  Description of Artificial Sequence: Synthetic oligonucleotide
tttctttcacagacaaatca

SEQ ID NO: 5055 - DNA, 20 bp, Artificial Sequence
  Description of Artificial Sequence: Synthetic oligonucleotide
ttctttcacagacaaatcat

SEQ ID NO: 5056 - DNA, 20 bp, Artificial Sequence
  Description of Artificial Sequence: Synthetic oligonucleotide
tctttcacagacaaatcatg

SEQ ID NO: 5057 - DNA, 20 bp, Artificial Sequence
  Description of Artificial Sequence: Synthetic oligonucleotide
ctttcacagacaaatcatgt

SEQ ID NO: 5058 - DNA, 20 bp, Artificial Sequence
  Description of Artificial Sequence: Synthetic oligonucleotide
tttcacagacaaatcatgtg

SEQ ID NO: 5059 - DNA, 20 bp, Artificial Sequence
  Description of Artificial Sequence: Synthetic oligonucleotide
ttcacagacaaatcatgtgg

SEQ ID NO: 5060 - DNA, 20 bp, Artificial Sequence
  Description of Artificial Sequence: Synthetic oligonucleotide
tcacagacaaatcatgtgga

SEQ ID NO: 5061 - DNA, 20 bp, Artificial Sequence
  Description of Artificial Sequence: Synthetic oligonucleotide
cacagacaaatcatgtggaa

SEQ ID NO: 5062 - DNA, 20 bp, Artificial Sequence
  Description of Artificial Sequence: Synthetic oligonucleotide
acagacaaatcatgtggaaa

SEQ ID NO: 5063 - DNA, 20 bp, Artificial Sequence
  Description of Artificial Sequence: Synthetic oligonucleotide
cagacaaatcatgtggaaaa

SEQ ID NO: 5064 - DNA, 20 bp, Artificial Sequence
  Description of Artificial Sequence: Synthetic oligonucleotide
agacaaatcatgtggaaaag

SEQ ID NO: 5065 - DNA, 20 bp, Artificial Sequence
  Description of Artificial Sequence: Synthetic oligonucleotide
gacaaatcatgtggaaaaga

SEQ ID NO: 5066 - DNA, 20 bp, Artificial Sequence
  Description of Artificial Sequence: Synthetic oligonucleotide
acaaatcatgtggaaaagac

SEQ ID NO: 5067 - DNA, 20 bp, Artificial Sequence
  Description of Artificial Sequence: Synthetic oligonucleotide
caaatcatgtggaaaagaca

SEQ ID NO: 5068 - DNA, 20 bp, Artificial Sequence
  Description of Artificial Sequence: Synthetic oligonucleotide
aaatcatgtggaaaagacaa

SEQ ID NO: 5069 - DNA, 20 bp, Artificial Sequence
  Description of Artificial Sequence: Synthetic oligonucleotide
aatcatgtggaaaagacaag

SEQ ID NO: 5070 - DNA, 20 bp, Artificial Sequence
  Description of Artificial Sequence: Synthetic oligonucleotide
atcatgtggaaaagacaagc

SEQ ID NO: 5071 - DNA, 20 bp, Artificial Sequence
  Description of Artificial Sequence: Synthetic oligonucleotide
tcatgtggaaaagacaagct

SEQ ID NO: 5072 - DNA, 20 bp, Artificial Sequence
  Description of Artificial Sequence: Synthetic oligonucleotide
catgtggaaaagacaagcta

SEQ ID NO: 5073 - DNA, 20 bp, Artificial Sequence
  Description of Artificial Sequence: Synthetic oligonucleotide
atgtggaaaagacaagctac

SEQ ID NO: 5074 - DNA, 20 bp, Artificial Sequence
  Description of Artificial Sequence: Synthetic oligonucleotide
tgtggaaaagacaagctact

SEQ ID NO: 5075 - DNA, 20 bp, Artificial Sequence
  Description of Artificial Sequence: Synthetic oligonucleotide
gtggaaaagacaagctactg

SEQ ID NO: 5076 - DNA, 20 bp, Artificial Sequence
  Description of Artificial Sequence: Synthetic oligonucleotide
tggaaaagacaagctactgc

SEQ ID NO: 5077 - DNA, 20 bp, Artificial Sequence
  Description of Artificial Sequence: Synthetic oligonucleotide
ggaaaagacaagctactgct

SEQ ID NO: 5078 - DNA, 20 bp, Artificial Sequence
  Description of Artificial Sequence: Synthetic oligonucleotide
gaaaagacaagctactgcta

SEQ ID NO: 5079 - DNA, 20 bp, Artificial Sequence
  Description of Artificial Sequence: Synthetic oligonucleotide
aaaagacaagctactgctat

SEQ ID NO: 5080 - DNA, 20 bp, Artificial Sequence
  Description of Artificial Sequence: Synthetic oligonucleotide
aaagacaagctactgctatg

SEQ ID NO: 5081 - DNA, 20 bp, Artificial Sequence
  Description of Artificial Sequence: Synthetic oligonucleotide
aagacaagctactgctatgt

SEQ ID NO: 5082 - DNA, 20 bp, Artificial Sequence
  Description of Artificial Sequence: Synthetic oligonucleotide
agacaagctactgctatgtc

SEQ ID NO: 5083 - DNA, 20 bp, Artificial Sequence
  Description of Artificial Sequence: Synthetic oligonucleotide
gacaagctactgctatgtca

SEQ ID NO: 5084 - DNA, 20 bp, Artificial Sequence
  Description of Artificial Sequence: Synthetic oligonucleotide
acaagctactgctatgtcag

SEQ ID NO: 5085 - DNA, 20 bp, Artificial Sequence
  Description of Artificial Sequence: Synthetic oligonucleotide
caagctactgctatgtcagg

SEQ ID NO: 5086 - DNA, 20 bp, Artificial Sequence
  Description of Artificial Sequence: Synthetic oligonucleotide
aagctactgctatgtcaggg

SEQ ID NO: 5087 - DNA, 20 bp, Artificial Sequence
  Description of Artificial Sequence: Synthetic oligonucleotide
agctactgctatgtcaggga

SEQ ID NO: 5088 - DNA, 20 bp, Artificial Sequence
  Description of Artificial Sequence: Synthetic oligonucleotide
gctactgctatgtcagggat

SEQ ID NO: 5089 - DNA, 20 bp, Artificial Sequence
  Description of Artificial Sequence: Synthetic oligonucleotide
ctactgctatgtcagggatc

SEQ ID NO: 5090 - DNA, 20 bp, Artificial Sequence
  Description of Artificial Sequence: Synthetic oligonucleotide
tactgctatgtcagggatct

SEQ ID NO: 5091 - DNA, 20 bp, Artificial Sequence
  Description of Artificial Sequence: Synthetic oligonucleotide
actgctatgtcagggatctt

SEQ ID NO: 5092 - DNA, 20 bp, Artificial Sequence
  Description of Artificial Sequence: Synthetic oligonucleotide
ctgctatgtcagggatcttg

SEQ ID NO: 5093 - DNA, 20 bp, Artificial Sequence
  Description of Artificial Sequence: Synthetic oligonucleotide
tgctatgtcagggatcttgg

SEQ ID NO: 5094 - DNA, 20 bp, Artificial Sequence
  Description of Artificial Sequence: Synthetic oligonucleotide
gctatgtcagggatcttggg

SEQ ID NO: 5095 - DNA, 20 bp, Artificial Sequence
  Description of Artificial Sequence: Synthetic oligonucleotide
ctatgtcagggatcttgggc

SEQ ID NO: 5096 - DNA, 20 bp, Artificial Sequence
  Description of Artificial Sequence: Synthetic oligonucleotide
tatgtcagggatcttgggca

SEQ ID NO: 5097 - DNA, 20 bp, Artificial Sequence
  Description of Artificial Sequence: Synthetic oligonucleotide
atgtcagggatcttgggcag

SEQ ID NO: 5098 - DNA, 20 bp, Artificial Sequence
  Description of Artificial Sequence: Synthetic oligonucleotide
tgtcagggatcttgggcaga

SEQ ID NO: 5099 - DNA, 20 bp, Artificial Sequence
  Description of Artificial Sequence: Synthetic oligonucleotide
gtcagggatcttgggcagag

SEQ ID NO: 5100 - DNA, 20 bp, Artificial Sequence
  Description of Artificial Sequence: Synthetic oligonucleotide
tcagggatcttgggcagaga

SEQ ID NO: 5101 - DNA, 20 bp, Artificial Sequence
  Description of Artificial Sequence: Synthetic oligonucleotide
cagggatcttgggcagagag

SEQ ID NO: 5102 - DNA, 20 bp, Artificial Sequence
  Description of Artificial Sequence: Synthetic oligonucleotide
agggatcttgggcagagaga

SEQ ID NO: 5103 - DNA, 20 bp, Artificial Sequence
  Description of Artificial Sequence: Synthetic oligonucleotide
gggatcttgggcagagagac

SEQ ID NO: 5104 - DNA, 20 bp, Artificial Sequence
  Description of Artificial Sequence: Synthetic oligonucleotide
ggatcttgggcagagagacc

SEQ ID NO: 5105 - DNA, 20 bp, Artificial Sequence
  Description of Artificial Sequence: Synthetic oligonucleotide
gatcttgggcagagagaccc

SEQ ID NO: 5106 - DNA, 20 bp, Artificial Sequence
  Description of Artificial Sequence: Synthetic oligonucleotide
atcttgggcagagagacccc

SEQ ID NO: 5107 - DNA, 20 bp, Artificial Sequence
  Description of Artificial Sequence: Synthetic oligonucleotide
tcttgggcagagagacccca

SEQ ID NO: 5108 - DNA, 20 bp, Artificial Sequence
  Description of Artificial Sequence: Synthetic oligonucleotide
cttgggcagagagaccccac

SEQ ID NO: 5109 - DNA, 20 bp, Artificial Sequence
  Description of Artificial Sequence: Synthetic oligonucleotide
ttgggcagagagaccccact

SEQ ID NO: 5110 - DNA, 20 bp, Artificial Sequence
  Description of Artificial Sequence: Synthetic oligonucleotide
tgggcagagagaccccactc

SEQ ID NO: 5111 - DNA, 20 bp, Artificial Sequence
  Description of Artificial Sequence: Synthetic oligonucleotide
gggcagagagaccccactca

SEQ ID NO: 5112 - DNA, 20 bp, Artificial Sequence
  Description of Artificial Sequence: Synthetic oligonucleotide
ggcagagagaccccactcag

SEQ ID NO: 5113 - DNA, 20 bp, Artificial Sequence
  Description of Artificial Sequence: Synthetic oligonucleotide
gcagagagaccccactcagt

SEQ ID NO: 5114 - DNA, 20 bp, Artificial Sequence
  Description of Artificial Sequence: Synthetic oligonucleotide
cagagagaccccactcagtc

SEQ ID NO: 5115 - DNA, 20 bp, Artificial Sequence
  Description of Artificial Sequence: Synthetic oligonucleotide
agagagaccccactcagtct

SEQ ID NO: 5116 - DNA, 20 bp, Artificial Sequence
  Description of Artificial Sequence: Synthetic oligonucleotide
gagagaccccactcagtcta

SEQ ID NO: 5117 - DNA, 20 bp, Artificial Sequence
  Description of Artificial Sequence: Synthetic oligonucleotide
agagaccccactcagtctac

SEQ ID NO: 5118 - DNA, 20 bp, Artificial Sequence
  Description of Artificial Sequence: Synthetic oligonucleotide
gagaccccactcagtctacc

SEQ ID NO: 5119 - DNA, 20 bp, Artificial Sequence
  Description of Artificial Sequence: Synthetic oligonucleotide
agaccccactcagtctacca

SEQ ID NO: 5120 - DNA, 20 bp, Artificial Sequence
  Description of Artificial Sequence: Synthetic oligonucleotide
gaccccactcagtctaccac

SEQ ID NO: 5121 - DNA, 20 bp, Artificial Sequence
  Description of Artificial Sequence: Synthetic oligonucleotide
accccactcagtctaccacc

SEQ ID NO: 5122 - DNA, 20 bp, Artificial Sequence
  Description of Artificial Sequence: Synthetic oligonucleotide
ccccactcagtctaccacct

SEQ ID NO: 5123 - DNA, 20 bp, Artificial Sequence
  Description of Artificial Sequence: Synthetic oligonucleotide
cccactcagtctaccacctt

SEQ ID NO: 5124 - DNA, 20 bp, Artificial Sequence
  Description of Artificial Sequence: Synthetic oligonucleotide
ccactcagtctaccaccttg

SEQ ID NO: 5125 - DNA, 20 bp, Artificial Sequence
  Description of Artificial Sequence: Synthetic oligonucleotide
cactcagtctaccaccttga

SEQ ID NO: 5126 - DNA, 20 bp, Artificial Sequence
  Description of Artificial Sequence: Synthetic oligonucleotide
actcagtctaccaccttgag

SEQ ID NO: 5127 - DNA, 20 bp, Artificial Sequence
  Description of Artificial Sequence: Synthetic oligonucleotide
ctcagtctaccaccttgaga

SEQ ID NO: 5128 - DNA, 20 bp, Artificial Sequence
  Description of Artificial Sequence: Synthetic oligonucleotide
tcagtctaccaccttgagaa

SEQ ID NO: 5129 - DNA, 20 bp, Artificial Sequence
  Description of Artificial Sequence: Synthetic oligonucleotide
cagtctaccaccttgagaag

SEQ ID NO: 5130 - DNA, 20 bp, Artificial Sequence
  Description of Artificial Sequence: Synthetic oligonucleotide
agtctaccaccttgagaagg

SEQ ID NO: 5131 - DNA, 20 bp, Artificial Sequence
  Description of Artificial Sequence: Synthetic oligonucleotide
gtctaccaccttgagaagga

SEQ ID NO: 5132 - DNA, 20 bp, Artificial Sequence
  Description of Artificial Sequence: Synthetic oligonucleotide
tctaccaccttgagaaggat

SEQ ID NO: 5133 - DNA, 20 bp, Artificial Sequence
  Description of Artificial Sequence: Synthetic oligonucleotide
ctaccaccttgagaaggatg

SEQ ID NO: 5134 - DNA, 20 bp, Artificial Sequence
  Description of Artificial Sequence: Synthetic oligonucleotide
taccaccttgagaaggatgt

SEQ ID NO: 5135 - DNA, 20 bp, Artificial Sequence
  Description of Artificial Sequence: Synthetic oligonucleotide
accaccttgagaaggatgtg

SEQ ID NO: 5136 - DNA, 20 bp, Artificial Sequence
  Description of Artificial Sequence: Synthetic oligonucleotide
ccaccttgagaaggatgtgg

SEQ ID NO: 5137 - DNA, 20 bp, Artificial Sequence
  Description of Artificial Sequence: Synthetic oligonucleotide
caccttgagaaggatgtggc

SEQ ID NO: 5138 - DNA, 20 bp, Artificial Sequence
  Description of Artificial Sequence: Synthetic oligonucleotide
accttgagaaggatgtggca

SEQ ID NO: 5139 - DNA, 20 bp, Artificial Sequence
  Description of Artificial Sequence: Synthetic oligonucleotide
ccttgagaaggatgtggcag

SEQ ID NO: 5140 - DNA, 20 bp, Artificial Sequence
  Description of Artificial Sequence: Synthetic oligonucleotide
cttgagaaggatgtggcagg

SEQ ID NO: 5141 - DNA, 20 bp, Artificial Sequence
  Description of Artificial Sequence: Synthetic oligonucleotide
ttgagaaggatgtggcagga

SEQ ID NO: 5142 - DNA, 20 bp, Artificial Sequence
  Description of Artificial Sequence: Synthetic oligonucleotide
tgagaaggatgtggcaggac

SEQ ID NO: 5143 - DNA, 20 bp, Artificial Sequence
  Description of Artificial Sequence: Synthetic oligonucleotide
gagaaggatgtggcaggacc

SEQ ID NO: 5144 - DNA, 20 bp, Artificial Sequence
  Description of Artificial Sequence: Synthetic oligonucleotide
agaaggatgtggcaggaccc

SEQ ID NO: 5145 - DNA, 20 bp, Artificial Sequence
  Description of Artificial Sequence: Synthetic oligonucleotide
gaaggatgtggcaggaccca

SEQ ID NO: 5146 - DNA, 20 bp, Artificial Sequence
  Description of Artificial Sequence: Synthetic oligonucleotide
aaggatgtggcaggacccag

SEQ ID NO: 5147 - DNA, 20 bp, Artificial Sequence
  Description of Artificial Sequence: Synthetic oligonucleotide
aggatgtggcaggacccagt

SEQ ID NO: 5148 - DNA, 20 bp, Artificial Sequence
  Description of Artificial Sequence: Synthetic oligonucleotide
ggatgtggcaggacccagtg

SEQ ID NO: 5149 - DNA, 20 bp, Artificial Sequence
  Description of Artificial Sequence: Synthetic oligonucleotide
gatgtggcaggacccagtgg

SEQ ID NO: 5150 - DNA, 20 bp, Artificial Sequence
  Description of Artificial Sequence: Synthetic oligonucleotide
atgtggcaggacccagtggg

SEQ ID NO: 5151 - DNA, 20 bp, Artificial Sequence
  Description of Artificial Sequence: Synthetic oligonucleotide
tgtggcaggacccagtgggt

SEQ ID NO: 5152 - DNA, 20 bp, Artificial Sequence
  Description of Artificial Sequence: Synthetic oligonucleotide
gtggcaggacccagtgggtt

SEQ ID NO: 5153 - DNA, 20 bp, Artificial Sequence
  Description of Artificial Sequence: Synthetic oligonucleotide
tggcaggacccagtgggttt

SEQ ID NO: 5154 - DNA, 20 bp, Artificial Sequence
  Description of Artificial Sequence: Synthetic oligonucleotide
ggcaggacccagtgggttta

SEQ ID NO: 5155 - DNA, 20 bp, Artificial Sequence
  Description of Artificial Sequence: Synthetic oligonucleotide
gcaggacccagtgggtttaa

SEQ ID NO: 5156 - DNA, 20 bp, Artificial Sequence
  Description of Artificial Sequence: Synthetic oligonucleotide
caggacccagtgggtttaaa

SEQ ID NO: 5157 - DNA, 20 bp, Artificial Sequence
  Description of Artificial Sequence: Synthetic oligonucleotide
aggacccagtgggtttaaat

SEQ ID NO: 5158 - DNA, 20 bp, Artificial Sequence
  Description of Artificial Sequence: Synthetic oligonucleotide
ggacccagtgggtttaaata

SEQ ID NO: 5159 - DNA, 20 bp, Artificial Sequence
  Description of Artificial Sequence: Synthetic oligonucleotide
gacccagtgggtttaaatag

SEQ ID NO: 5160 - DNA, 20 bp, Artificial Sequence
  Description of Artificial Sequence: Synthetic oligonucleotide
acccagtgggtttaaatagt

SEQ ID NO: 5161 - DNA, 20 bp, Artificial Sequence
  Description of Artificial Sequence: Synthetic oligonucleotide
cccagtgggtttaaatagtt

SEQ ID NO: 5162 - DNA, 20 bp, Artificial Sequence
  Description of Artificial Sequence: Synthetic oligonucleotide
ccagtgggtttaaatagttc

SEQ ID NO: 5163 - DNA, 20 bp, Artificial Sequence
  Description of Artificial Sequence: Synthetic oligonucleotide
cagtgggtttaaatagttca

SEQ ID NO: 5164 - DNA, 20 bp, Artificial Sequence
  Description of Artificial Sequence: Synthetic oligonucleotide
agtgggtttaaatagttcat

SEQ ID NO: 5165 - DNA, 20 bp, Artificial Sequence
  Description of Artificial Sequence: Synthetic oligonucleotide
gtgggtttaaatagttcatc

SEQ ID NO: 5166 - DNA, 20 bp, Artificial Sequence
  Description of Artificial Sequence: Synthetic oligonucleotide
tgggtttaaatagttcatcc

SEQ ID NO: 5167 - DNA, 20 bp, Artificial Sequence
  Description of Artificial Sequence: Synthetic oligonucleotide
gggtttaaatagttcatcct

SEQ ID NO: 5168 - DNA, 20 bp, Artificial Sequence
  Description of Artificial Sequence: Synthetic oligonucleotide
ggtttaaatagttcatcctg

SEQ ID NO: 5169 - DNA, 20 bp, Artificial Sequence
  Description of Artificial Sequence: Synthetic oligonucleotide
gtttaaatagttcatcctgt

SEQ ID NO: 5170 - DNA, 20 bp, Artificial Sequence
  Description of Artificial Sequence: Synthetic oligonucleotide
tttaaatagttcatcctgtt

SEQ ID NO: 5171 - DNA, 20 bp, Artificial Sequence
  Description of Artificial Sequence: Synthetic oligonucleotide
ttaaatagttcatcctgttt

SEQ ID NO: 5172 - DNA, 20 bp, Artificial Sequence
  Description of Artificial Sequence: Synthetic oligonucleotide
taaatagttcatcctgttta

SEQ ID NO: 5173 - DNA, 20 bp, Artificial Sequence
  Description of Artificial Sequence: Synthetic oligonucleotide
aaatagttcatcctgtttac

SEQ ID NO: 5174 - DNA, 20 bp, Artificial Sequence
  Description of Artificial Sequence: Synthetic oligonucleotide
aatagttcatcctgtttact

SEQ ID NO: 5175 - DNA, 20 bp, Artificial Sequence
  Description of Artificial Sequence: Synthetic oligonucleotide
atagttcatcctgtttactg

SEQ ID NO: 5176 - DNA, 20 bp, Artificial Sequence
  Description of Artificial Sequence: Synthetic oligonucleotide
tagttcatcctgtttactgt

SEQ ID NO: 5177 - DNA, 20 bp, Artificial Sequence
  Description of Artificial Sequence: Synthetic oligonucleotide
agttcatcctgtttactgta

SEQ ID NO: 5178 - DNA, 20 bp, Artificial Sequence
  Description of Artificial Sequence: Synthetic oligonucleotide
gttcatcctgtttactgtaa

SEQ ID NO: 5179 - DNA, 20 bp, Artificial Sequence
  Description of Artificial Sequence: Synthetic oligonucleotide
ttcatcctgtttactgtaac

SEQ ID NO: 5180 - DNA, 20 bp, Artificial Sequence
  Description of Artificial Sequence: Synthetic oligonucleotide
tcatcctgtttactgtaaca

SEQ ID NO: 5181 - DNA, 20 bp, Artificial Sequence
  Description of Artificial Sequence: Synthetic oligonucleotide
catcctgtttactgtaacat

SEQ ID NO: 5182 - DNA, 20 bp, Artificial Sequence
  Description of Artificial Sequence: Synthetic oligonucleotide
atcctgtttactgtaacatc

SEQ ID NO: 5183 - DNA, 20 bp, Artificial Sequence
  Description of Artificial Sequence: Synthetic oligonucleotide
tcctgtttactgtaacatcc

SEQ ID NO: 5184 - DNA, 20 bp, Artificial Sequence
  Description of Artificial Sequence: Synthetic oligonucleotide
cctgtttactgtaacatcct

SEQ ID NO: 5185 - DNA, 20 bp, Artificial Sequence
  Description of Artificial Sequence: Synthetic oligonucleotide
ctgtttactgtaacatcctt

SEQ ID NO: 5186 - DNA, 20 bp, Artificial Sequence
  Description of Artificial Sequence: Synthetic oligonucleotide
tgtttactgtaacatccttg

SEQ ID NO: 5187 - DNA, 20 bp, Artificial Sequence
  Description of Artificial Sequence: Synthetic oligonucleotide
gtttactgtaacatccttgg

SEQ ID NO: 5188 - DNA, 20 bp, Artificial Sequence
  Description of Artificial Sequence: Synthetic oligonucleotide
tttactgtaacatccttggt

SEQ ID NO: 5189 - DNA, 20 bp, Artificial Sequence
  Description of Artificial Sequence: Synthetic oligonucleotide
ttactgtaacatccttggta

SEQ ID NO: 5190 - DNA, 20 bp, Artificial Sequence
  Description of Artificial Sequence: Synthetic oligonucleotide
tactgtaacatccttggtac

SEQ ID NO: 5191 - DNA, 20 bp, Artificial Sequence
  Description of Artificial Sequence: Synthetic oligonucleotide
actgtaacatccttggtaca

SEQ ID NO: 5192 - DNA, 20 bp, Artificial Sequence
  Description of Artificial Sequence: Synthetic oligonucleotide
ctgtaacatccttggtacat

SEQ ID NO: 5193 - DNA, 20 bp, Artificial Sequence
  Description of Artificial Sequence: Synthetic oligonucleotide
tgtaacatccttggtacata

SEQ ID NO: 5194 - DNA, 20 bp, Artificial Sequence
  Description of Artificial Sequence: Synthetic oligonucleotide
gtaacatccttggtacatat

SEQ ID NO: 5195 - DNA, 20 bp, Artificial Sequence
  Description of Artificial Sequence: Synthetic oligonucleotide
taacatccttggtacatatg

SEQ ID NO: 5196 - DNA, 20 bp, Artificial Sequence
  Description of Artificial Sequence: Synthetic oligonucleotide
aacatccttggtacatatga

SEQ ID NO: 5197 - DNA, 20 bp, Artificial Sequence
  Description of Artificial Sequence: Synthetic oligonucleotide
acatccttggtacatatgat

SEQ ID NO: 5198 - DNA, 20 bp, Artificial Sequence
  Description of Artificial Sequence: Synthetic oligonucleotide
catccttggtacatatgatt

SEQ ID NO: 5199 - DNA, 20 bp, Artificial Sequence
  Description of Artificial Sequence: Synthetic oligonucleotide
atccttggtacatatgattt

SEQ ID NO: 5200 - DNA, 20 bp, Artificial Sequence
  Description of Artificial Sequence: Synthetic oligonucleotide
tccttggtacatatgatttt

SEQ ID NO: 5201 - DNA, 20 bp, Artificial Sequence
  Description of Artificial Sequence: Synthetic oligonucleotide
ccttggtacatatgattttt

SEQ ID NO: 5202 - DNA, 20 bp, Artificial Sequence
  Description of Artificial Sequence: Synthetic oligonucleotide
cttggtacatatgatttttt

SEQ ID NO: 5203 - DNA, 20 bp, Artificial Sequence
  Description of Artificial Sequence: Synthetic oligonucleotide
ttggtacatatgattttttt

SEQ ID NO: 5204 - DNA, 20 bp, Artificial Sequence
  Description of Artificial Sequence: Synthetic oligonucleotide
tggtacatatgatttttttg

SEQ ID NO: 5205 - DNA, 20 bp, Artificial Sequence
  Description of Artificial Sequence: Synthetic oligonucleotide
ggtacatatgatttttttgt

SEQ ID NO: 5206 - DNA, 20 bp, Artificial Sequence
  Description of Artificial Sequence: Synthetic oligonucleotide
gtacatatgatttttttgtg

SEQ ID NO: 5207 - DNA, 20 bp, Artificial Sequence
  Description of Artificial Sequence: Synthetic oligonucleotide
tacatatgatttttttgtgc

SEQ ID NO: 5208 - DNA, 20 bp, Artificial Sequence
  Description of Artificial Sequence: Synthetic oligonucleotide
acatatgatttttttgtgct

SEQ ID NO: 5209 - DNA, 20 bp, Artificial Sequence
  Description of Artificial Sequence: Synthetic oligonucleotide
catatgatttttttgtgctc

SEQ ID NO: 5210 - DNA, 20 bp, Artificial Sequence
  Description of Artificial Sequence: Synthetic oligonucleotide
atatgatttttttgtgctcc

SEQ ID NO: 5211 - DNA, 20 bp, Artificial Sequence
  Description of Artificial Sequence: Synthetic oligonucleotide
tatgatttttttgtgctcct

SEQ ID NO: 5212 - DNA, 20 bp, Artificial Sequence
  Description of Artificial Sequence: Synthetic oligonucleotide
atgatttttttgtgctcctt

SEQ ID NO: 5213 - DNA, 20 bp, Artificial Sequence
  Description of Artificial Sequence: Synthetic oligonucleotide
tgatttttttgtgctccttg

SEQ ID NO: 5214 - DNA, 20 bp, Artificial Sequence
  Description of Artificial Sequence: Synthetic oligonucleotide
gatttttttgtgctccttgg

SEQ ID NO: 5215 - DNA, 20 bp, Artificial Sequence
  Description of Artificial Sequence: Synthetic oligonucleotide
atttttttgtgctccttgga

SEQ ID NO: 5216 - DNA, 20 bp, Artificial Sequence
  Description of Artificial Sequence: Synthetic oligonucleotide
tttttttgtgctccttggag

SEQ ID NO: 5217 - DNA, 20 bp, Artificial Sequence
  Description of Artificial Sequence: Synthetic oligonucleotide
ttttttgtgctccttggaga

SEQ ID NO: 5218 - DNA, 20 bp, Artificial Sequence
  Description of Artificial Sequence: Synthetic oligonucleotide
tttttgtgctccttggagac

SEQ ID NO: 5219 - DNA, 20 bp, Artificial Sequence
  Description of Artificial Sequence: Synthetic oligonucleotide
ttttgtgctccttggagact

SEQ ID NO: 5220 - DNA, 20 bp, Artificial Sequence
  Description of Artificial Sequence: Synthetic oligonucleotide
tttgtgctccttggagactt

SEQ ID NO: 5221 - DNA, 20 bp, Artificial Sequence
  Description of Artificial Sequence: Synthetic oligonucleotide
ttgtgctccttggagactta

SEQ ID NO: 5222 - DNA, 20 bp, Artificial Sequence
  Description of Artificial Sequence: Synthetic oligonucleotide
tgtgctccttggagacttat

SEQ ID NO: 5223 - DNA, 20 bp, Artificial Sequence
  Description of Artificial Sequence: Synthetic oligonucleotide
gtgctccttggagacttatt

SEQ ID NO: 5224 - DNA, 20 bp, Artificial Sequence
  Description of Artificial Sequence: Synthetic oligonucleotide
tgctccttggagacttattc

SEQ ID NO: 5225 - DNA, 20 bp, Artificial Sequence
  Description of Artificial Sequence: Synthetic oligonucleotide
gctccttggagacttattct

SEQ ID NO: 5226 - DNA, 20 bp, Artificial Sequence
  Description of Artificial Sequence: Synthetic oligonucleotide
ctccttggagacttattctt

SEQ ID NO: 5227 - DNA, 20 bp, Artificial Sequence
  Description of Artificial Sequence: Synthetic oligonucleotide
tccttggagacttattcttt

SEQ ID NO: 5228 - DNA, 20 bp, Artificial Sequence
  Description of Artificial Sequence: Synthetic oligonucleotide
ccttggagacttattctttc

SEQ ID NO: 5229 - DNA, 20 bp, Artificial Sequence
  Description of Artificial Sequence: Synthetic oligonucleotide
cttggagacttattctttct

SEQ ID NO: 5230 - DNA, 20 bp, Artificial Sequence
  Description of Artificial Sequence: Synthetic oligonucleotide
ttggagacttattctttctt

SEQ ID NO: 5231 - DNA, 20 bp, Artificial Sequence
  Description of Artificial Sequence: Synthetic oligonucleotide
tggagacttattctttcttt

SEQ ID NO: 5232 - DNA, 20 bp, Artificial Sequence
  Description of Artificial Sequence: Synthetic oligonucleotide
ggagacttattctttctttg

SEQ ID NO: 5233 - DNA, 20 bp, Artificial Sequence
  Description of Artificial Sequence: Synthetic oligonucleotide
gagacttattctttctttgg

SEQ ID NO: 5234 - DNA, 20 bp, Artificial Sequence
  Description of Artificial Sequence: Synthetic oligonucleotide
agacttattctttctttgga

SEQ ID NO: 5235 - DNA, 20 bp, Artificial Sequence
  Description of Artificial Sequence: Synthetic oligonucleotide
gacttattctttctttggag

SEQ ID NO: 5236 - DNA, 20 bp, Artificial Sequence
  Description of Artificial Sequence: Synthetic oligonucleotide
acttattctttctttggaga

SEQ ID NO: 5237 - DNA, 20 bp, Artificial Sequence
  Description of Artificial Sequence: Synthetic oligonucleotide
cttattctttctttggagat

SEQ ID NO: 5238 - DNA, 20 bp, Artificial Sequence
  Description of Artificial Sequence: Synthetic oligonucleotide
ttattctttctttggagatt

SEQ ID NO: 5239 - DNA, 20 bp, Artificial Sequence
  Description of Artificial Sequence: Synthetic oligonucleotide
tattctttctttggagatta

SEQ ID NO: 5240 - DNA, 20 bp, Artificial Sequence
  Description of Artificial Sequence: Synthetic oligonucleotide
attctttctttggagattat

SEQ ID NO: 5241 - DNA, 20 bp, Artificial Sequence
  Description of Artificial Sequence: Synthetic oligonucleotide
ttctttctttggagattata

SEQ ID NO: 5242 - DNA, 20 bp, Artificial Sequence
  Description of Artificial Sequence: Synthetic oligonucleotide
tctttctttggagattatag

SEQ ID NO: 5243 - DNA, 20 bp, Artificial Sequence
  Description of Artificial Sequence: Synthetic oligonucleotide
ctttctttggagattatagg

SEQ ID NO: 5244 - DNA, 20 bp, Artificial Sequence
  Description of Artificial Sequence: Synthetic oligonucleotide
tttctttggagattataggc

SEQ ID NO: 5245 - DNA, 20 bp, Artificial Sequence
  Description of Artificial Sequence: Synthetic oligonucleotide
ttctttggagattataggct

SEQ ID NO: 5246 - DNA, 20 bp, Artificial Sequence
  Description of Artificial Sequence: Synthetic oligonucleotide
tctttggagattataggctg

SEQ ID NO: 5247 - DNA, 20 bp, Artificial Sequence
  Description of Artificial Sequence: Synthetic oligonucleotide
ctttggagattataggctgt

SEQ ID NO: 5248 - DNA, 20 bp, Artificial Sequence
  Description of Artificial Sequence: Synthetic oligonucleotide
tttggagattataggctgtt

SEQ ID NO: 5249 - DNA, 20 bp, Artificial Sequence
  Description of Artificial Sequence: Synthetic oligonucleotide
ttggagattataggctgttt

SEQ ID NO: 5250 - DNA, 20 bp, Artificial Sequence
  Description of Artificial Sequence: Synthetic oligonucleotide
tggagattataggctgtttc

SEQ ID NO: 5251 - DNA, 20 bp, Artificial Sequence
  Description of Artificial Sequence: Synthetic oligonucleotide
ggagattataggctgtttct

SEQ ID NO: 5252 - DNA, 20 bp, Artificial Sequence
  Description of Artificial Sequence: Synthetic oligonucleotide
gagattataggctgtttctc

SEQ ID NO: 5253 - DNA, 20 bp, Artificial Sequence
  Description of Artificial Sequence: Synthetic oligonucleotide
agattataggctgtttctca

SEQ ID NO: 5254 - DNA, 20 bp, Artificial Sequence
  Description of Artificial Sequence: Synthetic oligonucleotide
gattataggctgtttctcag

SEQ ID NO: 5255 - DNA, 20 bp, Artificial Sequence
  Description of Artificial Sequence: Synthetic oligonucleotide
attataggctgtttctcagt

SEQ ID NO: 5256 - DNA, 20 bp, Artificial Sequence
  Description of Artificial Sequence: Synthetic oligonucleotide
ttataggctgtttctcagtc

SEQ ID NO: 5257 - DNA, 20 bp, Artificial Sequence
  Description of Artificial Sequence: Synthetic oligonucleotide
tataggctgtttctcagtcc

SEQ ID NO: 5258 - DNA, 20 bp, Artificial Sequence
  Description of Artificial Sequence: Synthetic oligonucleotide
ataggctgtttctcagtcct

SEQ ID NO: 5259 - DNA, 20 bp, Artificial Sequence
  Description of Artificial Sequence: Synthetic oligonucleotide
taggctgtttctcagtccta

SEQ ID NO: 5260 - DNA, 20 bp, Artificial Sequence
  Description of Artificial Sequence: Synthetic oligonucleotide
aggctgtttctcagtcctac

SEQ ID NO: 5261 - DNA, 20 bp, Artificial Sequence
  Description of Artificial Sequence: Synthetic oligonucleotide
ggctgtttctcagtcctacc

SEQ ID NO: 5262 - DNA, 20 bp, Artificial Sequence
  Description of Artificial Sequence: Synthetic oligonucleotide
gctgtttctcagtcctaccc

SEQ ID NO: 5263 - DNA, 20 bp, Artificial Sequence
  Description of Artificial Sequence: Synthetic oligonucleotide
ctgtttctcagtcctaccct

SEQ ID NO: 5264 - DNA, 20 bp, Artificial Sequence
  Description of Artificial Sequence: Synthetic oligonucleotide
tgtttctcagtcctaccctt

SEQ ID NO: 5265 - DNA, 20 bp, Artificial Sequence
  Description of Artificial Sequence: Synthetic oligonucleotide
gtttctcagtcctacccttt

SEQ ID NO: 5266 - DNA, 20 bp, Artificial Sequence
  Description of Artificial Sequence: Synthetic oligonucleotide
tttctcagtcctaccctttc

SEQ ID NO: 5267 - DNA, 20 bp, Artificial Sequence
  Description of Artificial Sequence: Synthetic oligonucleotide
ttctcagtcctaccctttct

SEQ ID NO: 5268 - DNA, 20 bp, Artificial Sequence
  Description of Artificial Sequence: Synthetic oligonucleotide
tctcagtcctaccctttcta

SEQ ID NO: 5269 - DNA, 20 bp, Artificial Sequence
  Description of Artificial Sequence: Synthetic oligonucleotide
ctcagtcctaccctttctaa

SEQ ID NO: 5270 - DNA, 20 bp, Artificial Sequence
  Description of Artificial Sequence: Synthetic oligonucleotide
tcagtcctaccctttctaac

SEQ ID NO: 5271 - DNA, 20 bp, Artificial Sequence
  Description of Artificial Sequence: Synthetic oligonucleotide
cagtcctaccctttctaaca

SEQ ID NO: 5272 - DNA, 20 bp, Artificial Sequence
  Description of Artificial Sequence: Synthetic oligonucleotide
agtcctaccctttctaacac

SEQ ID NO: 5273 - DNA, 20 bp, Artificial Sequence
  Description of Artificial Sequence: Synthetic oligonucleotide
gtcctaccctttctaacact

SEQ ID NO: 5274 - DNA, 20 bp, Artificial Sequence
  Description of Artificial Sequence: Synthetic oligonucleotide
tcctaccctttctaacactc

SEQ ID NO: 5275 - DNA, 20 bp, Artificial Sequence
  Description of Artificial Sequence: Synthetic oligonucleotide
cctaccctttctaacactct

SEQ ID NO: 5276 - DNA, 20 bp, Artificial Sequence
  Description of Artificial Sequence: Synthetic oligonucleotide
ctaccctttctaacactctc

SEQ ID NO: 5277 - DNA, 20 bp, Artificial Sequence
  Description of Artificial Sequence: Synthetic oligonucleotide
taccctttctaacactctct

SEQ ID NO: 5278 - DNA, 20 bp, Artificial Sequence
  Description of Artificial Sequence: Synthetic oligonucleotide
accctttctaacactctctt

SEQ ID NO: 5279 - DNA, 20 bp, Artificial Sequence
  Description of Artificial Sequence: Synthetic oligonucleotide
ccctttctaacactctcttc

SEQ ID NO: 5280 - DNA, 20 bp, Artificial Sequence
  Description of Artificial Sequence: Synthetic oligonucleotide
cctttctaacactctcttcc

SEQ ID NO: 5281 - DNA, 20 bp, Artificial Sequence
  Description of Artificial Sequence: Synthetic oligonucleotide
ctttctaacactctcttcct

SEQ ID NO: 5282 - DNA, 20 bp, Artificial Sequence
  Description of Artificial Sequence: Synthetic oligonucleotide
tttctaacactctcttcctg

SEQ ID NO: 5283 - DNA, 20 bp, Artificial Sequence
  Description of Artificial Sequence: Synthetic oligonucleotide
ttctaacactctcttcctgt

SEQ ID NO: 5284 - DNA, 20 bp, Artificial Sequence
  Description of Artificial Sequence: Synthetic oligonucleotide
tctaacactctcttcctgtc

SEQ ID NO: 5285 - DNA, 20 bp, Artificial Sequence
  Description of Artificial Sequence: Synthetic oligonucleotide
ctaacactctcttcctgtcc

SEQ ID NO: 5286 - DNA, 20 bp, Artificial Sequence
  Description of Artificial Sequence: Synthetic oligonucleotide
taacactctcttcctgtcct

SEQ ID NO: 5287 - DNA, 20 bp, Artificial Sequence
  Description of Artificial Sequence: Synthetic oligonucleotide
aacactctcttcctgtcctc

SEQ ID NO: 5288 - DNA, 20 bp, Artificial Sequence
  Description of Artificial Sequence: Synthetic oligonucleotide
acactctcttcctgtcctca

SEQ ID NO: 5289 - DNA, 20 bp, Artificial Sequence
  Description of Artificial Sequence: Synthetic oligonucleotide
cactctcttcctgtcctcat

SEQ ID NO: 5290 - DNA, 20 bp, Artificial Sequence
  Description of Artificial Sequence: Synthetic oligonucleotide
actctcttcctgtcctcatc

SEQ ID NO: 5291 - DNA, 20 bp, Artificial Sequence
  Description of Artificial Sequence: Synthetic oligonucleotide
ctctcttcctgtcctcatct

SEQ ID NO: 5292 - DNA, 20 bp, Artificial Sequence
  Description of Artificial Sequence: Synthetic oligonucleotide
tctcttcctgtcctcatctg

SEQ ID NO: 5293 - DNA, 20 bp, Artificial Sequence
  Description of Artificial Sequence: Synthetic oligonucleotide
ctcttcctgtcctcatctgc

SEQ ID NO: 5294 - DNA, 20 bp, Artificial Sequence
  Description of Artificial Sequence: Synthetic oligonucleotide
tcttcctgtcctcatctgcc

SEQ ID NO: 5295 - DNA, 20 bp, Artificial Sequence
  Description of Artificial Sequence: Synthetic oligonucleotide
cttcctgtcctcatctgccc

SEQ ID NO: 5296 - DNA, 20 bp, Artificial Sequence
  Description of Artificial Sequence: Synthetic oligonucleotide
ttcctgtcctcatctgccct

SEQ ID NO: 5297 - DNA, 20 bp, Artificial Sequence
  Description of Artificial Sequence: Synthetic oligonucleotide
tcctgtcctcatctgccctc

SEQ ID NO: 5298 - DNA, 20 bp, Artificial Sequence
  Description of Artificial Sequence: Synthetic oligonucleotide
cctgtcctcatctgccctca

SEQ ID NO: 5299 - DNA, 20 bp, Artificial Sequence
  Description of Artificial Sequence: Synthetic oligonucleotide
ctgtcctcatctgccctcat

SEQ ID NO: 5300 - DNA, 20 bp, Artificial Sequence
  Description of Artificial Sequence: Synthetic oligonucleotide
tgtcctcatctgccctcatc

SEQ ID NO: 5301 - DNA, 20 bp, Artificial Sequence
  Description of Artificial Sequence: Synthetic oligonucleotide
gtcctcatctgccctcatcc

SEQ ID NO: 5302 - DNA, 20 bp, Artificial Sequence
  Description of Artificial Sequence: Synthetic oligonucleotide
tcctcatctgccctcatcca

SEQ ID NO: 5303 - DNA, 20 bp, Artificial Sequence
  Description of Artificial Sequence: Synthetic oligonucleotide
cctcatctgccctcatccag

SEQ ID NO: 5304 - DNA, 20 bp, Artificial Sequence
  Description of Artificial Sequence: Synthetic oligonucleotide
ctcatctgccctcatccagt

SEQ ID NO: 5305 - DNA, 20 bp, Artificial Sequence
  Description of Artificial Sequence: Synthetic oligonucleotide
tcatctgccctcatccagtc

SEQ ID NO: 5306 - DNA, 20 bp, Artificial Sequence
  Description of Artificial Sequence: Synthetic oligonucleotide
catctgccctcatccagtct

SEQ ID NO: 5307 - DNA, 20 bp, Artificial Sequence
  Description of Artificial Sequence: Synthetic oligonucleotide
atctgccctcatccagtctc

SEQ ID NO: 5308 - DNA, 20 bp, Artificial Sequence
  Description of Artificial Sequence: Synthetic oligonucleotide
tctgccctcatccagtctcc

SEQ ID NO: 5309 - DNA, 20 bp, Artificial Sequence
  Description of Artificial Sequence: Synthetic oligonucleotide
ctgccctcatccagtctcca

SEQ ID NO: 5310 - DNA, 20 bp, Artificial Sequence
  Description of Artificial Sequence: Synthetic oligonucleotide
tgccctcatccagtctccac

SEQ ID NO: 5311 - DNA, 20 bp, Artificial Sequence
  Description of Artificial Sequence: Synthetic oligonucleotide
gccctcatccagtctccacg

SEQ ID NO: 5312 - DNA, 20 bp, Artificial Sequence
  Description of Artificial Sequence: Synthetic oligonucleotide
ccctcatccagtctccacgt

SEQ ID NO: 5313 - DNA, 20 bp, Artificial Sequence
  Description of Artificial Sequence: Synthetic oligonucleotide
cctcatccagtctccacgtg

SEQ ID NO: 5314 - DNA, 20 bp, Artificial Sequence
  Description of Artificial Sequence: Synthetic oligonucleotide
ctcatccagtctccacgtgt

SEQ ID NO: 5315 - DNA, 20 bp, Artificial Sequence
  Description of Artificial Sequence: Synthetic oligonucleotide
tcatccagtctccacgtgtc

SEQ ID NO: 5316 - DNA, 20 bp, Artificial Sequence
  Description of Artificial Sequence: Synthetic oligonucleotide
catccagtctccacgtgtct

SEQ ID NO: 5317 - DNA, 20 bp, Artificial Sequence
  Description of Artificial Sequence: Synthetic oligonucleotide
atccagtctccacgtgtctc

SEQ ID NO: 5318 - DNA, 20 bp, Artificial Sequence
  Description of Artificial Sequence: Synthetic oligonucleotide
tccagtctccacgtgtctca

SEQ ID NO: 5319 - DNA, 20 bp, Artificial Sequence
  Description of Artificial Sequence: Synthetic oligonucleotide
ccagtctccacgtgtctcag

SEQ ID NO: 5320 - DNA, 20 bp, Artificial Sequence
  Description of Artificial Sequence: Synthetic oligonucleotide
cagtctccacgtgtctcagt

SEQ ID NO: 5321 - DNA, 20 bp, Artificial Sequence
  Description of Artificial Sequence: Synthetic oligonucleotide
agtctccacgtgtctcagtt

SEQ ID NO: 5322 - DNA, 20 bp, Artificial Sequence
  Description of Artificial Sequence: Synthetic oligonucleotide
gtctccacgtgtctcagttt

SEQ ID NO: 5323 - DNA, 20 bp, Artificial Sequence
  Description of Artificial Sequence: Synthetic oligonucleotide
tctccacgtgtctcagtttc

SEQ ID NO: 5324 - DNA, 20 bp, Artificial Sequence
  Description of Artificial Sequence: Synthetic oligonucleotide
ctccacgtgtctcagtttct

SEQ ID NO: 5325 - DNA, 20 bp, Artificial Sequence
  Description of Artificial Sequence: Synthetic oligonucleotide
tccacgtgtctcagtttctg

SEQ ID NO: 5326 - DNA, 20 bp, Artificial Sequence
  Description of Artificial Sequence: Synthetic oligonucleotide
ccacgtgtctcagtttctgt

SEQ ID NO: 5327 - DNA, 20 bp, Artificial Sequence
  Description of Artificial Sequence: Synthetic oligonucleotide
cacgtgtctcagtttctgta

SEQ ID NO: 5328 - DNA, 20 bp, Artificial Sequence
  Description of Artificial Sequence: Synthetic oligonucleotide
acgtgtctcagtttctgtat

SEQ ID NO: 5329 - DNA, 20 bp, Artificial Sequence
  Description of Artificial Sequence: Synthetic oligonucleotide
cgtgtctcagtttctgtatc

SEQ ID NO: 5330 - DNA, 20 bp, Artificial Sequence
  Description of Artificial Sequence: Synthetic oligonucleotide
gtgtctcagtttctgtatcc

SEQ ID NO: 5331 - DNA, 20 bp, Artificial Sequence
  Description of Artificial Sequence: Synthetic oligonucleotide
tgtctcagtttctgtatccg

SEQ ID NO: 5332 - DNA, 20 bp, Artificial Sequence
  Description of Artificial Sequence: Synthetic oligonucleotide
gtctcagtttctgtatccgt

SEQ ID NO: 5333 - DNA, 20 bp, Artificial Sequence
  Description of Artificial Sequence: Synthetic oligonucleotide
tctcagtttctgtatccgtg

SEQ ID NO: 5334 - DNA, 20 bp, Artificial Sequence
  Description of Artificial Sequence: Synthetic oligonucleotide
ctcagtttctgtatccgtgc

SEQ ID NO: 5335 - DNA, 20 bp, Artificial Sequence
  Description of Artificial Sequence: Synthetic oligonucleotide
tcagtttctgtatccgtgct

SEQ ID NO: 5336 - DNA, 20 bp, Artificial Sequence
  Description of Artificial Sequence: Synthetic oligonucleotide
cagtttctgtatccgtgctc

SEQ ID NO: 5337 - DNA, 20 bp, Artificial Sequence
  Description of Artificial Sequence: Synthetic oligonucleotide
agtttctgtatccgtgctcc

SEQ ID NO: 5338 - DNA, 20 bp, Artificial Sequence
  Description of Artificial Sequence: Synthetic oligonucleotide
gtttctgtatccgtgctcca

SEQ ID NO: 5339 - DNA, 20 bp, Artificial Sequence
  Description of Artificial Sequence: Synthetic oligonucleotide
tttctgtatccgtgctccac

SEQ ID NO: 5340 - DNA, 20 bp, Artificial Sequence
  Description of Artificial Sequence: Synthetic oligonucleotide
ttctgtatccgtgctccacg

SEQ ID NO: 5341 - DNA, 20 bp, Artificial Sequence
  Description of Artificial Sequence: Synthetic oligonucleotide
tctgtatccgtgctccacgg

SEQ ID NO: 5342 - DNA, 20 bp, Artificial Sequence
  Description of Artificial Sequence: Synthetic oligonucleotide
ctgtatccgtgctccacggc

SEQ ID NO: 5343 - DNA, 20 bp, Artificial Sequence
  Description of Artificial Sequence: Synthetic oligonucleotide
tgtatccgtgctccacggca

SEQ ID NO: 5344 - DNA, 20 bp, Artificial Sequence
  Description of Artificial Sequence: Synthetic oligonucleotide
gtatccgtgctccacggcag

SEQ ID NO: 5345 - DNA, 20 bp, Artificial Sequence
  Description of Artificial Sequence: Synthetic oligonucleotide
tatccgtgctccacggcagc

SEQ ID NO: 5346 - DNA, 20 bp, Artificial Sequence
  Description of Artificial Sequence: Synthetic oligonucleotide
atccgtgctccacggcagcc

SEQ ID NO: 5347 - DNA, 20 bp, Artificial Sequence
  Description of Artificial Sequence: Synthetic oligonucleotide
tccgtgctccacggcagcct

SEQ ID NO: 5348 - DNA, 20 bp, Artificial Sequence
  Description of Artificial Sequence: Synthetic oligonucleotide
ccgtgctccacggcagcctc

SEQ ID NO: 5349 - DNA, 20 bp, Artificial Sequence
  Description of Artificial Sequence: Synthetic oligonucleotide
cgtgctccacggcagcctcc

SEQ ID NO: 5350 - DNA, 20 bp, Artificial Sequence
  Description of Artificial Sequence: Synthetic oligonucleotide
gtgctccacggcagcctcct

SEQ ID NO: 5351 - DNA, 20 bp, Artificial Sequence
  Description of Artificial Sequence: Synthetic oligonucleotide
tgctccacggcagcctcctt

SEQ ID NO: 5352 - DNA, 20 bp, Artificial Sequence
  Description of Artificial Sequence: Synthetic oligonucleotide
gctccacggcagcctccttt

SEQ ID NO: 5353 - DNA, 20 bp, Artificial Sequence
  Description of Artificial Sequence: Synthetic oligonucleotide
ctccacggcagcctcctttt

SEQ ID NO: 5354 - DNA, 20 bp, Artificial Sequence
  Description of Artificial Sequence: Synthetic oligonucleotide
tccacggcagcctcctttta

SEQ ID NO: 5355 - DNA, 20 bp, Artificial Sequence
  Description of Artificial Sequence: Synthetic oligonucleotide
ccacggcagcctccttttaa

SEQ ID NO: 5356 - DNA, 20 bp, Artificial Sequence
  Description of Artificial Sequence: Synthetic oligonucleotide
cacggcagcctccttttaag

SEQ ID NO: 5357 - DNA, 20 bp, Artificial Sequence
  Description of Artificial Sequence: Synthetic oligonucleotide
acggcagcctccttttaagg

SEQ ID NO: 5358 - DNA, 20 bp, Artificial Sequence
  Description of Artificial Sequence: Synthetic oligonucleotide
cggcagcctccttttaaggc

SEQ ID NO: 5359 - DNA, 20 bp, Artificial Sequence
  Description of Artificial Sequence: Synthetic oligonucleotide
ggcagcctccttttaaggct

SEQ ID NO: 5360 - DNA, 20 bp, Artificial Sequence
  Description of Artificial Sequence: Synthetic oligonucleotide
gcagcctccttttaaggctt

SEQ ID NO: 5361 - DNA, 20 bp, Artificial Sequence
  Description of Artificial Sequence: Synthetic oligonucleotide
cagcctccttttaaggcttg

SEQ ID NO: 5362 - DNA, 20 bp, Artificial Sequence
  Description of Artificial Sequence: Synthetic oligonucleotide
agcctccttttaaggcttga

SEQ ID NO: 5363 - DNA, 20 bp, Artificial Sequence
  Description of Artificial Sequence: Synthetic oligonucleotide
gcctccttttaaggcttgaa

SEQ ID NO: 5364 - DNA, 20 bp, Artificial Sequence
  Description of Artificial Sequence: Synthetic oligonucleotide
cctccttttaaggcttgaag

SEQ ID NO: 5365 - DNA, 20 bp, Artificial Sequence
  Description of Artificial Sequence: Synthetic oligonucleotide
ctccttttaaggcttgaagt

SEQ ID NO: 5366 - DNA, 20 bp, Artificial Sequence
  Description of Artificial Sequence: Synthetic oligonucleotide
tccttttaaggcttgaagtc

SEQ ID NO: 5367 - DNA, 20 bp, Artificial Sequence
  Description of Artificial Sequence: Synthetic oligonucleotide
ccttttaaggcttgaagtct

SEQ ID NO: 5368 - DNA, 20 bp, Artificial Sequence
  Description of Artificial Sequence: Synthetic oligonucleotide
cttttaaggcttgaagtctt

SEQ ID NO: 5369 - DNA, 20 bp, Artificial Sequence
  Description of Artificial Sequence: Synthetic oligonucleotide
ttttaaggcttgaagtcttc

SEQ ID NO: 5370 - DNA, 20 bp, Artificial Sequence
  Description of Artificial Sequence: Synthetic oligonucleotide
tttaaggcttgaagtcttct

SEQ ID NO: 5371 - DNA, 20 bp, Artificial Sequence
  Description of Artificial Sequence: Synthetic oligonucleotide
ttaaggcttgaagtcttctg

SEQ ID NO: 5372 - DNA, 20 bp, Artificial Sequence
  Description of Artificial Sequence: Synthetic oligonucleotide
taaggcttgaagtcttctgg

SEQ ID NO: 5373 - DNA, 20 bp, Artificial Sequence
  Description of Artificial Sequence: Synthetic oligonucleotide
aaggcttgaagtcttctggg

SEQ ID NO: 5374 - DNA, 20 bp, Artificial Sequence
  Description of Artificial Sequence: Synthetic oligonucleotide
aggcttgaagtcttctgggc

SEQ ID NO: 5375 - DNA, 20 bp, Artificial Sequence
  Description of Artificial Sequence: Synthetic oligonucleotide
ggcttgaagtcttctgggcg

SEQ ID NO: 5376 - DNA, 20 bp, Artificial Sequence
  Description of Artificial Sequence: Synthetic oligonucleotide
gcttgaagtcttctgggcgg

SEQ ID NO: 5377 - DNA, 20 bp, Artificial Sequence
  Description of Artificial Sequence: Synthetic oligonucleotide
cttgaagtcttctgggcgga

SEQ ID NO: 5378 - DNA, 20 bp, Artificial Sequence
  Description of Artificial Sequence: Synthetic oligonucleotide
ttgaagtcttctgggcggat

SEQ ID NO: 5379 - DNA, 20 bp, Artificial Sequence
  Description of Artificial Sequence: Synthetic oligonucleotide
tgaagtcttctgggcggatt

SEQ ID NO: 5380 - DNA, 20 bp, Artificial Sequence
  Description of Artificial Sequence: Synthetic oligonucleotide
gaagtcttctgggcggattt

SEQ ID NO: 5381 - DNA, 20 bp, Artificial Sequence
  Description of Artificial Sequence: Synthetic oligonucleotide
aagtcttctgggcggatttt

SEQ ID NO: 5382 - DNA, 20 bp, Artificial Sequence
  Description of Artificial Sequence: Synthetic oligonucleotide
agtcttctgggcggattttc

SEQ ID NO: 5383 - DNA, 20 bp, Artificial Sequence
  Description of Artificial Sequence: Synthetic oligonucleotide
gtcttctgggcggattttca

SEQ ID NO: 5384 - DNA, 20 bp, Artificial Sequence
  Description of Artificial Sequence: Synthetic oligonucleotide
tcttctgggcggattttcat

SEQ ID NO: 5385 - DNA, 20 bp, Artificial Sequence
  Description of Artificial Sequence: Synthetic oligonucleotide
cttctgggcggattttcatc

SEQ ID NO: 5386 - DNA, 20 bp, Artificial Sequence
  Description of Artificial Sequence: Synthetic oligonucleotide
ttctgggcggattttcatct

SEQ ID NO: 5387 - DNA, 20 bp, Artificial Sequence
  Description of Artificial Sequence: Synthetic oligonucleotide
tctgggcggattttcatctc

SEQ ID NO: 5388 - DNA, 20 bp, Artificial Sequence
  Description of Artificial Sequence: Synthetic oligonucleotide
ctgggcggattttcatctcc

SEQ ID NO: 5389 - DNA, 20 bp, Artificial Sequence
  Description of Artificial Sequence: Synthetic oligonucleotide
tgggcggattttcatctcca

SEQ ID NO: 5390 - DNA, 20 bp, Artificial Sequence
  Description of Artificial Sequence: Synthetic oligonucleotide
gggcggattttcatctccac

SEQ ID NO: 5391 - DNA, 20 bp, Artificial Sequence
  Description of Artificial Sequence: Synthetic oligonucleotide
ggcggattttcatctccacc

SEQ ID NO: 5392 - DNA, 20 bp, Artificial Sequence
  Description of Artificial Sequence: Synthetic oligonucleotide
gcggattttcatctccaccc

SEQ ID NO: 5393 - DNA, 20 bp, Artificial Sequence
  Description of Artificial Sequence: Synthetic oligonucleotide
cggattttcatctccacccg

SEQ ID NO: 5394 - DNA, 20 bp, Artificial Sequence
  Description of Artificial Sequence: Synthetic oligonucleotide
ggattttcatctccacccgt

SEQ ID NO: 5395 - DNA, 20 bp, Artificial Sequence
  Description of Artificial Sequence: Synthetic oligonucleotide
gattttcatctccacccgtt

SEQ ID NO: 5396 - DNA, 20 bp, Artificial Sequence
  Description of Artificial Sequence: Synthetic oligonucleotide
attttcatctccacccgttt

SEQ ID NO: 5397 - DNA, 20 bp, Artificial Sequence
  Description of Artificial Sequence: Synthetic oligonucleotide
ttttcatctccacccgtttg

SEQ ID NO: 5398 - DNA, 20 bp, Artificial Sequence
  Description of Artificial Sequence: Synthetic oligonucleotide
tttcatctccacccgtttga

SEQ ID NO: 5399 - DNA, 20 bp, Artificial Sequence
  Description of Artificial Sequence: Synthetic oligonucleotide
ttcatctccacccgtttgag

SEQ ID NO: 5400 - DNA, 20 bp, Artificial Sequence
  Description of Artificial Sequence: Synthetic oligonucleotide
tcatctccacccgtttgagg

SEQ ID NO: 5401 - DNA, 20 bp, Artificial Sequence
  Description of Artificial Sequence: Synthetic oligonucleotide
catctccacccgtttgaggg

SEQ ID NO: 5402 - DNA, 20 bp, Artificial Sequence
  Description of Artificial Sequence: Synthetic oligonucleotide
atctccacccgtttgaggga

SEQ ID NO: 5403 - DNA, 20 bp, Artificial Sequence
  Description of Artificial Sequence: Synthetic oligonucleotide
tctccacccgtttgagggag

SEQ ID NO: 5404 - DNA, 20 bp, Artificial Sequence
  Description of Artificial Sequence: Synthetic oligonucleotide
ctccacccgtttgagggagt

SEQ ID NO: 5405 - DNA, 20 bp, Artificial Sequence
  Description of Artificial Sequence: Synthetic oligonucleotide
tccacccgtttgagggagta

SEQ ID NO: 5406 - DNA, 20 bp, Artificial Sequence
  Description of Artificial Sequence: Synthetic oligonucleotide
ccacccgtttgagggagtag

SEQ ID NO: 5407 - DNA, 20 bp, Artificial Sequence
  Description of Artificial Sequence: Synthetic oligonucleotide
cacccgtttgagggagtagg

SEQ ID NO: 5408 - DNA, 20 bp, Artificial Sequence
  Description of Artificial Sequence: Synthetic oligonucleotide
acccgtttgagggagtaggt

SEQ ID NO: 5409 - DNA, 20 bp, Artificial Sequence
  Description of Artificial Sequence: Synthetic oligonucleotide
cccgtttgagggagtaggta

SEQ ID NO: 5410 - DNA, 20 bp, Artificial Sequence
  Description of Artificial Sequence: Synthetic oligonucleotide
ccgtttgagggagtaggtag

SEQ ID NO: 5411 - DNA, 20 bp, Artificial Sequence
  Description of Artificial Sequence: Synthetic oligonucleotide
cgtttgagggagtaggtaga

SEQ ID NO: 5412 - DNA, 20 bp, Artificial Sequence
  Description of Artificial Sequence: Synthetic oligonucleotide
gtttgagggagtaggtagat

SEQ ID NO: 5413 - DNA, 20 bp, Artificial Sequence
  Description of Artificial Sequence: Synthetic oligonucleotide
tttgagggagtaggtagatc

SEQ ID NO: 5414 - DNA, 20 bp, Artificial Sequence
  Description of Artificial Sequence: Synthetic oligonucleotide
ttgagggagtaggtagatcc

SEQ ID NO: 5415 - DNA, 20 bp, Artificial Sequence
  Description of Artificial Sequence: Synthetic oligonucleotide
tgagggagtaggtagatcca

SEQ ID NO: 5416 - DNA, 20 bp, Artificial Sequence
  Description of Artificial Sequence: Synthetic oligonucleotide
gagggagtaggtagatccat

SEQ ID NO: 5417 - DNA, 20 bp, Artificial Sequence
  Description of Artificial Sequence: Synthetic oligonucleotide
agggagtaggtagatccatg

SEQ ID NO: 5418 - DNA, 20 bp, Artificial Sequence
  Description of Artificial Sequence: Synthetic oligonucleotide
gggagtaggtagatccatgc

SEQ ID NO: 5419 - DNA, 20 bp, Artificial Sequence
  Description of Artificial Sequence: Synthetic oligonucleotide
ggagtaggtagatccatgcc

SEQ ID NO: 5420 - DNA, 20 bp, Artificial Sequence
  Description of Artificial Sequence: Synthetic oligonucleotide
gagtaggtagatccatgcca

SEQ ID NO: 5421 - DNA, 20 bp, Artificial Sequence
  Description of Artificial Sequence: Synthetic oligonucleotide
agtaggtagatccatgccag

SEQ ID NO: 5422 - DNA, 20 bp, Artificial Sequence
  Description of Artificial Sequence: Synthetic oligonucleotide
gtaggtagatccatgccagc

SEQ ID NO: 5423 - DNA, 20 bp, Artificial Sequence
  Description of Artificial Sequence: Synthetic oligonucleotide
taggtagatccatgccagcc

SEQ ID NO: 5424 - DNA, 20 bp, Artificial Sequence
  Description of Artificial Sequence: Synthetic oligonucleotide
aggtagatccatgccagcca

SEQ ID NO: 5425 - DNA, 20 bp, Artificial Sequence
  Description of Artificial Sequence: Synthetic oligonucleotide
ggtagatccatgccagccat

SEQ ID NO: 5426 - DNA, 20 bp, Artificial Sequence
  Description of Artificial Sequence: Synthetic oligonucleotide
gtagatccatgccagccata

SEQ ID NO: 5427 - DNA, 20 bp, Artificial Sequence
  Description of Artificial Sequence: Synthetic oligonucleotide
tagatccatgccagccatac

SEQ ID NO: 5428 - DNA, 20 bp, Artificial Sequence
  Description of Artificial Sequence: Synthetic oligonucleotide
agatccatgccagccatacc

SEQ ID NO: 5429 - DNA, 20 bp, Artificial Sequence
  Description of Artificial Sequence: Synthetic oligonucleotide
gatccatgccagccatacca

SEQ ID NO: 5430 - DNA, 20 bp, Artificial Sequence
  Description of Artificial Sequence: Synthetic oligonucleotide
atccatgccagccataccag

SEQ ID NO: 5431 - DNA, 20 bp, Artificial Sequence
  Description of Artificial Sequence: Synthetic oligonucleotide
tccatgccagccataccagg

SEQ ID NO: 5432 - DNA, 20 bp, Artificial Sequence
  Description of Artificial Sequence: Synthetic oligonucleotide
ccatgccagccataccaggt

SEQ ID NO: 5433 - DNA, 20 bp, Artificial Sequence
  Description of Artificial Sequence: Synthetic oligonucleotide
catgccagccataccaggtg

SEQ ID NO: 5434 - DNA, 20 bp, Artificial Sequence
  Description of Artificial Sequence: Synthetic oligonucleotide
atgccagccataccaggtga

SEQ ID NO: 5435 - DNA, 20 bp, Artificial Sequence
  Description of Artificial Sequence: Synthetic oligonucleotide
tgccagccataccaggtgat

SEQ ID NO: 5436 - DNA, 20 bp, Artificial Sequence
  Description of Artificial Sequence: Synthetic oligonucleotide
gccagccataccaggtgatg

SEQ ID NO: 5437 - DNA, 20 bp, Artificial Sequence
  Description of Artificial Sequence: Synthetic oligonucleotide
ccagccataccaggtgatgc

SEQ ID NO: 5438 - DNA, 20 bp, Artificial Sequence
  Description of Artificial Sequence: Synthetic oligonucleotide
cagccataccaggtgatgcc

SEQ ID NO: 5439 - DNA, 20 bp, Artificial Sequence
  Description of Artificial Sequence: Synthetic oligonucleotide
agccataccaggtgatgcca

SEQ ID NO: 5440 - DNA, 20 bp, Artificial Sequence
  Description of Artificial Sequence: Synthetic oligonucleotide
gccataccaggtgatgccat

SEQ ID NO: 5441 - DNA, 20 bp, Artificial Sequence
  Description of Artificial Sequence: Synthetic oligonucleotide
ccataccaggtgatgccatc

SEQ ID NO: 5442 - DNA, 20 bp, Artificial Sequence
  Description of Artificial Sequence: Synthetic oligonucleotide
cataccaggtgatgccatcc

SEQ ID NO: 5443 - DNA, 20 bp, Artificial Sequence
  Description of Artificial Sequence: Synthetic oligonucleotide
ataccaggtgatgccatcca

SEQ ID NO: 5444 - DNA, 20 bp, Artificial Sequence
  Description of Artificial Sequence: Synthetic oligonucleotide
taccaggtgatgccatccag

SEQ ID NO: 5445 - DNA, 20 bp, Artificial Sequence
  Description of Artificial Sequence: Synthetic oligonucleotide
accaggtgatgccatccagg

SEQ ID NO: 5446 - DNA, 20 bp, Artificial Sequence
  Description of Artificial Sequence: Synthetic oligonucleotide
ccaggtgatgccatccaggt

SEQ ID NO: 5447 - DNA, 20 bp, Artificial Sequence
  Description of Artificial Sequence: Synthetic oligonucleotide
caggtgatgccatccaggtg

SEQ ID NO: 5448 - DNA, 20 bp, Artificial Sequence
  Description of Artificial Sequence: Synthetic oligonucleotide
aggtgatgccatccaggtgc

SEQ ID NO: 5449 - DNA, 20 bp, Artificial Sequence
  Description of Artificial Sequence: Synthetic oligonucleotide
ggtgatgccatccaggtgct

SEQ ID NO: 5450 - DNA, 20 bp, Artificial Sequence
  Description of Artificial Sequence: Synthetic oligonucleotide
gtgatgccatccaggtgctt

SEQ ID NO: 5451 - DNA, 20 bp, Artificial Sequence
  Description of Artificial Sequence: Synthetic oligonucleotide
tgatgccatccaggtgctta

SEQ ID NO: 5452 - DNA, 20 bp, Artificial Sequence
  Description of Artificial Sequence: Synthetic oligonucleotide
gatgccatccaggtgcttat

SEQ ID NO: 5453 - DNA, 20 bp, Artificial Sequence
  Description of Artificial Sequence: Synthetic oligonucleotide
atgccatccaggtgcttatt

SEQ ID NO: 5454 - DNA, 20 bp, Artificial Sequence
  Description of Artificial Sequence: Synthetic oligonucleotide
tgccatccaggtgcttattg

SEQ ID NO: 5455 - DNA, 20 bp, Artificial Sequence
  Description of Artificial Sequence: Synthetic oligonucleotide
gccatccaggtgcttattgt

SEQ ID NO: 5456 - DNA, 20 bp, Artificial Sequence
  Description of Artificial Sequence: Synthetic oligonucleotide
ccatccaggtgcttattgtg

SEQ ID NO: 5457 - DNA, 20 bp, Artificial Sequence
  Description of Artificial Sequence: Synthetic oligonucleotide
catccaggtgcttattgtgc

SEQ ID NO: 5458 - DNA, 20 bp, Artificial Sequence
  Description of Artificial Sequence: Synthetic oligonucleotide
atccaggtgcttattgtgct

SEQ ID NO: 5459 - DNA, 20 bp, Artificial Sequence
  Description of Artificial Sequence: Synthetic oligonucleotide
tccaggtgcttattgtgctc

SEQ ID NO: 5460 - DNA, 20 bp, Artificial Sequence
  Description of Artificial Sequence: Synthetic oligonucleotide
ccaggtgcttattgtgctca

SEQ ID NO: 5461 - DNA, 20 bp, Artificial Sequence
  Description of Artificial Sequence: Synthetic oligonucleotide
caggtgcttattgtgctcac

SEQ ID NO: 5462 - DNA, 20 bp, Artificial Sequence
  Description of Artificial Sequence: Synthetic oligonucleotide
aggtgcttattgtgctcacc

SEQ ID NO: 5463 - DNA, 20 bp, Artificial Sequence
  Description of Artificial Sequence: Synthetic oligonucleotide
ggtgcttattgtgctcaccc

SEQ ID NO: 5464 - DNA, 20 bp, Artificial Sequence
  Description of Artificial Sequence: Synthetic oligonucleotide
gtgcttattgtgctcaccca

SEQ ID NO: 5465 - DNA, 20 bp, Artificial Sequence
  Description of Artificial Sequence: Synthetic oligonucleotide
tgcttattgtgctcacccag

SEQ ID NO: 5466 - DNA, 20 bp, Artificial Sequence
  Description of Artificial Sequence: Synthetic oligonucleotide
gcttattgtgctcacccagg

SEQ ID NO: 5467 - DNA, 20 bp, Artificial Sequence
  Description of Artificial Sequence: Synthetic oligonucleotide
cttattgtgctcacccaggc

SEQ ID NO: 5468 - DNA, 20 bp, Artificial Sequence
  Description of Artificial Sequence: Synthetic oligonucleotide
ttattgtgctcacccaggcg

SEQ ID NO: 5469 - DNA, 20 bp, Artificial Sequence
  Description of Artificial Sequence: Synthetic oligonucleotide
tattgtgctcacccaggcgg

SEQ ID NO: 5470 - DNA, 20 bp, Artificial Sequence
  Description of Artificial Sequence: Synthetic oligonucleotide
attgtgctcacccaggcggt

SEQ ID NO: 5471 - DNA, 20 bp, Artificial Sequence
  Description of Artificial Sequence: Synthetic oligonucleotide
ttgtgctcacccaggcggta

SEQ ID NO: 5472 - DNA, 20 bp, Artificial Sequence
  Description of Artificial Sequence: Synthetic oligonucleotide
tgtgctcacccaggcggtag

SEQ ID NO: 5473 - DNA, 20 bp, Artificial Sequence
  Description of Artificial Sequence: Synthetic oligonucleotide
gtgctcacccaggcggtagt

SEQ ID NO: 5474 - DNA, 20 bp, Artificial Sequence
  Description of Artificial Sequence: Synthetic oligonucleotide
tgctcacccaggcggtagta

SEQ ID NO: 5475 - DNA, 20 bp, Artificial Sequence
  Description of Artificial Sequence: Synthetic oligonucleotide
gctcacccaggcggtagtac

SEQ ID NO: 5476 - DNA, 20 bp, Artificial Sequence
  Description of Artificial Sequence: Synthetic oligonucleotide
ctcacccaggcggtagtaca

SEQ ID NO: 5477 - DNA, 20 bp, Artificial Sequence
  Description of Artificial Sequence: Synthetic oligonucleotide
tcacccaggcggtagtacac

SEQ ID NO: 5478 - DNA, 20 bp, Artificial Sequence
  Description of Artificial Sequence: Synthetic oligonucleotide
cacccaggcggtagtacact

SEQ ID NO: 5479 - DNA, 20 bp, Artificial Sequence
  Description of Artificial Sequence: Synthetic oligonucleotide
acccaggcggtagtacactc

SEQ ID NO: 5480 - DNA, 20 bp, Artificial Sequence
  Description of Artificial Sequence: Synthetic oligonucleotide
cccaggcggtagtacactcc

SEQ ID NO: 5481 - DNA, 20 bp, Artificial Sequence
  Description of Artificial Sequence: Synthetic oligonucleotide
ccaggcggtagtacactcca

SEQ ID NO: 5482 - DNA, 20 bp, Artificial Sequence
  Description of Artificial Sequence: Synthetic oligonucleotide
caggcggtagtacactccat

SEQ ID NO: 5483 - DNA, 20 bp, Artificial Sequence
  Description of Artificial Sequence: Synthetic oligonucleotide
aggcggtagtacactccatt

SEQ ID NO: 5484 - DNA, 20 bp, Artificial Sequence
  Description of Artificial Sequence: Synthetic oligonucleotide
ggcggtagtacactccattg

SEQ ID NO: 5485 - DNA, 20 bp, Artificial Sequence
  Description of Artificial Sequence: Synthetic oligonucleotide
gcggtagtacactccattga

SEQ ID NO: 5486 - DNA, 20 bp, Artificial Sequence
  Description of Artificial Sequence: Synthetic oligonucleotide
cggtagtacactccattgag

SEQ ID NO: 5487 - DNA, 20 bp, Artificial Sequence
  Description of Artificial Sequence: Synthetic oligonucleotide
ggtagtacactccattgagg

SEQ ID NO: 5488 - DNA, 20 bp, Artificial Sequence
  Description of Artificial Sequence: Synthetic oligonucleotide
gtagtacactccattgaggt

SEQ ID NO: 5489 - DNA, 20 bp, Artificial Sequence
  Description of Artificial Sequence: Synthetic oligonucleotide
tagtacactccattgaggtt

SEQ ID NO: 5490 - DNA, 20 bp, Artificial Sequence
  Description of Artificial Sequence: Synthetic oligonucleotide
agtacactccattgaggttg

SEQ ID NO: 5491 - DNA, 20 bp, Artificial Sequence
  Description of Artificial Sequence: Synthetic oligonucleotide
gtacactccattgaggttgg

SEQ ID NO: 5492 - DNA, 20 bp, Artificial Sequence
  Description of Artificial Sequence: Synthetic oligonucleotide
tacactccattgaggttgga

SEQ ID NO: 5493 - DNA, 20 bp, Artificial Sequence
  Description of Artificial Sequence: Synthetic oligonucleotide
acactccattgaggttggag

SEQ ID NO: 5494 - DNA, 20 bp, Artificial Sequence
  Description of Artificial Sequence: Synthetic oligonucleotide
cactccattgaggttggagt

SEQ ID NO: 5495 - DNA, 20 bp, Artificial Sequence
  Description of Artificial Sequence: Synthetic oligonucleotide
actccattgaggttggagtc

SEQ ID NO: 5496 - DNA, 20 bp, Artificial Sequence
  Description of Artificial Sequence: Synthetic oligonucleotide
ctccattgaggttggagtct

SEQ ID NO: 5497 - DNA, 20 bp, Artificial Sequence
  Description of Artificial Sequence: Synthetic oligonucleotide
tccattgaggttggagtctg

SEQ ID NO: 5498 - DNA, 20 bp, Artificial Sequence
  Description of Artificial Sequence: Synthetic oligonucleotide
ccattgaggttggagtctgt

SEQ ID NO: 5499 - DNA, 20 bp, Artificial Sequence
  Description of Artificial Sequence: Synthetic oligonucleotide
cattgaggttggagtctgtg

SEQ ID NO: 5500 - DNA, 20 bp, Artificial Sequence
  Description of Artificial Sequence: Synthetic oligonucleotide
attgaggttggagtctgtgc

SEQ ID NO: 5501 - DNA, 20 bp, Artificial Sequence
  Description of Artificial Sequence: Synthetic oligonucleotide
ttgaggttggagtctgtgca

SEQ ID NO: 5502 - DNA, 20 bp, Artificial Sequence
  Description of Artificial Sequence: Synthetic oligonucleotide
tgaggttggagtctgtgcag

SEQ ID NO: 5503 - DNA, 20 bp, Artificial Sequence
  Description of Artificial Sequence: Synthetic oligonucleotide
gaggttggagtctgtgcagc

SEQ ID NO: 5504 - DNA, 20 bp, Artificial Sequence
  Description of Artificial Sequence: Synthetic oligonucleotide
aggttggagtctgtgcagca

SEQ ID NO: 5505 - DNA, 20 bp, Artificial Sequence
  Description of Artificial Sequence: Synthetic oligonucleotide
ggttggagtctgtgcagcag

SEQ ID NO: 5506 - DNA, 20 bp, Artificial Sequence
  Description of Artificial Sequence: Synthetic oligonucleotide
gttggagtctgtgcagcagt

SEQ ID NO: 5507 - DNA, 20 bp, Artificial Sequence
  Description of Artificial Sequence: Synthetic oligonucleotide
ttggagtctgtgcagcagtt

SEQ ID NO: 5508 - DNA, 20 bp, Artificial Sequence
  Description of Artificial Sequence: Synthetic oligonucleotide
tggagtctgtgcagcagttg

SEQ ID NO: 5509 - DNA, 20 bp, Artificial Sequence
  Description of Artificial Sequence: Synthetic oligonucleotide
ggagtctgtgcagcagttgt

SEQ ID NO: 5510 - DNA, 20 bp, Artificial Sequence
  Description of Artificial Sequence: Synthetic oligonucleotide
gagtctgtgcagcagttgta

SEQ ID NO: 5511 - DNA, 20 bp, Artificial Sequence
  Description of Artificial Sequence: Synthetic oligonucleotide
agtctgtgcagcagttgtac

SEQ ID NO: 5512 - DNA, 20 bp, Artificial Sequence
  Description of Artificial Sequence: Synthetic oligonucleotide
gtctgtgcagcagttgtacc

SEQ ID NO: 5513 - DNA, 20 bp, Artificial Sequence
  Description of Artificial Sequence: Synthetic oligonucleotide
tctgtgcagcagttgtacca

SEQ ID NO: 5514 - DNA, 20 bp, Artificial Sequence
  Description of Artificial Sequence: Synthetic oligonucleotide
ctgtgcagcagttgtaccag

SEQ ID NO: 5515 - DNA, 20 bp, Artificial Sequence
  Description of Artificial Sequence: Synthetic oligonucleotide
tgtgcagcagttgtaccagt

SEQ ID NO: 5516 - DNA, 20 bp, Artificial Sequence
  Description of Artificial Sequence: Synthetic oligonucleotide
gtgcagcagttgtaccagta

SEQ ID NO: 5517 - DNA, 20 bp, Artificial Sequence
  Description of Artificial Sequence: Synthetic oligonucleotide
tgcagcagttgtaccagtag

SEQ ID NO: 5518 - DNA, 20 bp, Artificial Sequence
  Description of Artificial Sequence: Synthetic oligonucleotide
gcagcagttgtaccagtagc

SEQ ID NO: 5519 - DNA, 20 bp, Artificial Sequence
  Description of Artificial Sequence: Synthetic oligonucleotide
cagcagttgtaccagtagcc

SEQ ID NO: 5520 - DNA, 20 bp, Artificial Sequence
  Description of Artificial Sequence: Synthetic oligonucleotide
agcagttgtaccagtagcca

SEQ ID NO: 5521 - DNA, 20 bp, Artificial Sequence
  Description of Artificial Sequence: Synthetic oligonucleotide
gcagttgtaccagtagccac

SEQ ID NO: 5522 - DNA, 20 bp, Artificial Sequence
  Description of Artificial Sequence: Synthetic oligonucleotide
cagttgtaccagtagccacc

SEQ ID NO: 5523 - DNA, 20 bp, Artificial Sequence
  Description of Artificial Sequence: Synthetic oligonucleotide
agttgtaccagtagccacct

SEQ ID NO: 5524 - DNA, 20 bp, Artificial Sequence
  Description of Artificial Sequence: Synthetic oligonucleotide
gttgtaccagtagccacctg

SEQ ID NO: 5525 - DNA, 20 bp, Artificial Sequence
  Description of Artificial Sequence: Synthetic oligonucleotide
ttgtaccagtagccacctgg

SEQ ID NO: 5526 - DNA, 20 bp, Artificial Sequence
  Description of Artificial Sequence: Synthetic oligonucleotide
tgtaccagtagccacctggc

SEQ ID NO: 5527 - DNA, 20 bp, Artificial Sequence
  Description of Artificial Sequence: Synthetic oligonucleotide
gtaccagtagccacctggca

SEQ ID NO: 5528 - DNA, 20 bp, Artificial Sequence
  Description of Artificial Sequence: Synthetic oligonucleotide
taccagtagccacctggcat

SEQ ID NO: 5529 - DNA, 20 bp, Artificial Sequence
  Description of Artificial Sequence: Synthetic oligonucleotide
accagtagccacctggcatg

SEQ ID NO: 5530 - DNA, 20 bp, Artificial Sequence
  Description of Artificial Sequence: Synthetic oligonucleotide
ccagtagccacctggcatga

SEQ ID NO: 5531 - DNA, 20 bp, Artificial Sequence
  Description of Artificial Sequence: Synthetic oligonucleotide
cagtagccacctggcatgag

SEQ ID NO: 5532 - DNA, 20 bp, Artificial Sequence
  Description of Artificial Sequence: Synthetic oligonucleotide
agtagccacctggcatgaga

SEQ ID NO: 5533 - DNA, 20 bp, Artificial Sequence
  Description of Artificial Sequence: Synthetic oligonucleotide
gtagccacctggcatgagaa

SEQ ID NO: 5534 - DNA, 20 bp, Artificial Sequence
  Description of Artificial Sequence: Synthetic oligonucleotide
tagccacctggcatgagaaa

SEQ ID NO: 5535 - DNA, 20 bp, Artificial Sequence
  Description of Artificial Sequence: Synthetic oligonucleotide
agccacctggcatgagaaac

SEQ ID NO: 5536 - DNA, 20 bp, Artificial Sequence
  Description of Artificial Sequence: Synthetic oligonucleotide
gccacctggcatgagaaaca

SEQ ID NO: 5537 - DNA, 20 bp, Artificial Sequence
  Description of Artificial Sequence: Synthetic oligonucleotide
ccacctggcatgagaaacag

SEQ ID NO: 5538 - DNA, 20 bp, Artificial Sequence
  Description of Artificial Sequence: Synthetic oligonucleotide
cacctggcatgagaaacaga

SEQ ID NO: 5539 - DNA, 20 bp, Artificial Sequence
  Description of Artificial Sequence: Synthetic oligonucleotide
acctggcatgagaaacagac

SEQ ID NO: 5540 - DNA, 20 bp, Artificial Sequence
  Description of Artificial Sequence: Synthetic oligonucleotide
cctggcatgagaaacagacc

SEQ ID NO: 5541 - DNA, 20 bp, Artificial Sequence
  Description of Artificial Sequence: Synthetic oligonucleotide
ctggcatgagaaacagaccc

SEQ ID NO: 5542 - DNA, 20 bp, Artificial Sequence
  Description of Artificial Sequence: Synthetic oligonucleotide
tggcatgagaaacagaccca

SEQ ID NO: 5543 - DNA, 20 bp, Artificial Sequence
  Description of Artificial Sequence: Synthetic oligonucleotide
ggcatgagaaacagacccag

SEQ ID NO: 5544 - DNA, 20 bp, Artificial Sequence
  Description of Artificial Sequence: Synthetic oligonucleotide
gcatgagaaacagacccagt

SEQ ID NO: 5545 - DNA, 20 bp, Artificial Sequence
  Description of Artificial Sequence: Synthetic oligonucleotide
catgagaaacagacccagtg

SEQ ID NO: 5546 - DNA, 20 bp, Artificial Sequence
  Description of Artificial Sequence: Synthetic oligonucleotide
atgagaaacagacccagtgc

SEQ ID NO: 5547 - DNA, 20 bp, Artificial Sequence
  Description of Artificial Sequence: Synthetic oligonucleotide
tgagaaacagacccagtgct

SEQ ID NO: 5548 - DNA, 20 bp, Artificial Sequence
  Description of Artificial Sequence: Synthetic oligonucleotide
gagaaacagacccagtgcta

SEQ ID NO: 5549 - DNA, 20 bp, Artificial Sequence
  Description of Artificial Sequence: Synthetic oligonucleotide
agaaacagacccagtgctag

SEQ ID NO: 5550 - DNA, 20 bp, Artificial Sequence
  Description of Artificial Sequence: Synthetic oligonucleotide
gaaacagacccagtgctagt

SEQ ID NO: 5551 - DNA, 20 bp, Artificial Sequence
  Description of Artificial Sequence: Synthetic oligonucleotide
aaacagacccagtgctagta

SEQ ID NO: 5552 - DNA, 20 bp, Artificial Sequence
  Description of Artificial Sequence: Synthetic oligonucleotide
aacagacccagtgctagtaa

SEQ ID NO: 5553 - DNA, 20 bp, Artificial Sequence
  Description of Artificial Sequence: Synthetic oligonucleotide
acagacccagtgctagtaag

SEQ ID NO: 5554 - DNA, 20 bp, Artificial Sequence
  Description of Artificial Sequence: Synthetic oligonucleotide
cagacccagtgctagtaagt

SEQ ID NO: 5555 - DNA, 20 bp, Artificial Sequence
  Description of Artificial Sequence: Synthetic oligonucleotide
agacccagtgctagtaagtt

SEQ ID NO: 5556 - DNA, 20 bp, Artificial Sequence
  Description of Artificial Sequence: Synthetic oligonucleotide
gacccagtgctagtaagttg

SEQ ID NO: 5557 - DNA, 20 bp, Artificial Sequence
  Description of Artificial Sequence: Synthetic oligonucleotide
acccagtgctagtaagttga

SEQ ID NO: 5558 - DNA, 20 bp, Artificial Sequence
  Description of Artificial Sequence: Synthetic oligonucleotide
cccagtgctagtaagttgac

SEQ ID NO: 5559 - DNA, 20 bp, Artificial Sequence
  Description of Artificial Sequence: Synthetic oligonucleotide
ccagtgctagtaagttgact

SEQ ID NO: 5560 - DNA, 20 bp, Artificial Sequence
  Description of Artificial Sequence: Synthetic oligonucleotide
cagtgctagtaagttgactg

SEQ ID NO: 5561 - DNA, 20 bp, Artificial Sequence
  Description of Artificial Sequence: Synthetic oligonucleotide
agtgctagtaagttgactgt

SEQ ID NO: 5562 - DNA, 20 bp, Artificial Sequence
  Description of Artificial Sequence: Synthetic oligonucleotide
gtgctagtaagttgactgtg

SEQ ID NO: 5563 - DNA, 20 bp, Artificial Sequence
  Description of Artificial Sequence: Synthetic oligonucleotide
tgctagtaagttgactgtga

SEQ ID NO: 5564 - DNA, 20 bp, Artificial Sequence
  Description of Artificial Sequence: Synthetic oligonucleotide
gctagtaagttgactgtgat

SEQ ID NO: 5565 - DNA, 20 bp, Artificial Sequence
  Description of Artificial Sequence: Synthetic oligonucleotide
ctagtaagttgactgtgata

SEQ ID NO: 5566 - DNA, 20 bp, Artificial Sequence
  Description of Artificial Sequence: Synthetic oligonucleotide
tagtaagttgactgtgatag

SEQ ID NO: 5567 - DNA, 20 bp, Artificial Sequence
  Description of Artificial Sequence: Synthetic oligonucleotide
agtaagttgactgtgataga

SEQ ID NO: 5568 - DNA, 20 bp, Artificial Sequence
  Description of Artificial Sequence: Synthetic oligonucleotide
gtaagttgactgtgatagac

SEQ ID NO: 5569 - DNA, 20 bp, Artificial Sequence
  Description of Artificial Sequence: Synthetic oligonucleotide
taagttgactgtgatagacc

SEQ ID NO: 5570 - DNA, 20 bp, Artificial Sequence
  Description of Artificial Sequence: Synthetic oligonucleotide
aagttgactgtgatagacca

SEQ ID NO: 5571 - DNA, 20 bp, Artificial Sequence
  Description of Artificial Sequence: Synthetic oligonucleotide
agttgactgtgatagaccag

SEQ ID NO: 5572 - DNA, 20 bp, Artificial Sequence
  Description of Artificial Sequence: Synthetic oligonucleotide
gttgactgtgatagaccaga

SEQ ID NO: 5573 - DNA, 20 bp, Artificial Sequence
  Description of Artificial Sequence: Synthetic oligonucleotide
ttgactgtgatagaccagac

SEQ ID NO: 5574 - DNA, 20 bp, Artificial Sequence
  Description of Artificial Sequence: Synthetic oligonucleotide
tgactgtgatagaccagaca

SEQ ID NO: 5575 - DNA, 20 bp, Artificial Sequence
  Description of Artificial Sequence: Synthetic oligonucleotide
gactgtgatagaccagacat

SEQ ID NO: 5576 - DNA, 20 bp, Artificial Sequence
  Description of Artificial Sequence: Synthetic oligonucleotide
actgtgatagaccagacatc

SEQ ID NO: 5577 - DNA, 20 bp, Artificial Sequence
  Description of Artificial Sequence: Synthetic oligonucleotide
ctgtgatagaccagacatca

SEQ ID NO: 5578 - DNA, 20 bp, Artificial Sequence
  Description of Artificial Sequence: Synthetic oligonucleotide
tgtgatagaccagacatcag

SEQ ID NO: 5579 - DNA, 20 bp, Artificial Sequence
  Description of Artificial Sequence: Synthetic oligonucleotide
gtgatagaccagacatcagg

SEQ ID NO: 5580 - DNA, 20 bp, Artificial Sequence
  Description of Artificial Sequence: Synthetic oligonucleotide
tgatagaccagacatcaggt

SEQ ID NO: 5581 - DNA, 20 bp, Artificial Sequence
  Description of Artificial Sequence: Synthetic oligonucleotide
gatagaccagacatcaggta

SEQ ID NO: 5582 - DNA, 20 bp, Artificial Sequence
  Description of Artificial Sequence: Synthetic oligonucleotide
atagaccagacatcaggtaa

SEQ ID NO: 5583 - DNA, 20 bp, Artificial Sequence
  Description of Artificial Sequence: Synthetic oligonucleotide
tagaccagacatcaggtaag

SEQ ID NO: 5584 - DNA, 20 bp, Artificial Sequence
  Description of Artificial Sequence: Synthetic oligonucleotide
agaccagacatcaggtaagg

SEQ ID NO: 5585 - DNA, 20 bp, Artificial Sequence
  Description of Artificial Sequence: Synthetic oligonucleotide
gaccagacatcaggtaagga

SEQ ID NO: 5586 - DNA, 20 bp, Artificial Sequence
  Description of Artificial Sequence: Synthetic oligonucleotide
accagacatcaggtaaggag

SEQ ID NO: 5587 - DNA, 20 bp, Artificial Sequence
  Description of Artificial Sequence: Synthetic oligonucleotide
ccagacatcaggtaaggagt

SEQ ID NO: 5588 - DNA, 20 bp, Artificial Sequence
  Description of Artificial Sequence: Synthetic oligonucleotide
cagacatcaggtaaggagtt

SEQ ID NO: 5589 - DNA, 20 bp, Artificial Sequence
  Description of Artificial Sequence: Synthetic oligonucleotide
agacatcaggtaaggagtta

SEQ ID NO: 5590 - DNA, 20 bp, Artificial Sequence
  Description of Artificial Sequence: Synthetic oligonucleotide
gacatcaggtaaggagttag

SEQ ID NO: 5591 - DNA, 20 bp, Artificial Sequence
  Description of Artificial Sequence: Synthetic oligonucleotide
acatcaggtaaggagttaga

SEQ ID NO: 5592 - DNA, 20 bp, Artificial Sequence
  Description of Artificial Sequence: Synthetic oligonucleotide
catcaggtaaggagttagag

SEQ ID NO: 5593 - DNA, 20 bp, Artificial Sequence
  Description of Artificial Sequence: Synthetic oligonucleotide
atcaggtaaggagttagagc

SEQ ID NO: 5594 - DNA, 20 bp, Artificial Sequence
  Description of Artificial Sequence: Synthetic oligonucleotide
tcaggtaaggagttagagcc

SEQ ID NO: 5595 - DNA, 20 bp, Artificial Sequence
  Description of Artificial Sequence: Synthetic oligonucleotide
caggtaaggagttagagcca

SEQ ID NO: 5596 - DNA, 20 bp, Artificial Sequence
  Description of Artificial Sequence: Synthetic oligonucleotide
aggtaaggagttagagccag

SEQ ID NO: 5597 - DNA, 20 bp, Artificial Sequence
  Description of Artificial Sequence: Synthetic oligonucleotide
ggtaaggagttagagccagg

SEQ ID NO: 5598 - DNA, 20 bp, Artificial Sequence
  Description of Artificial Sequence: Synthetic oligonucleotide
gtaaggagttagagccaggg

SEQ ID NO: 5599 - DNA, 20 bp, Artificial Sequence
  Description of Artificial Sequence: Synthetic oligonucleotide
taaggagttagagccagggt

SEQ ID NO: 5600 - DNA, 20 bp, Artificial Sequence
  Description of Artificial Sequence: Synthetic oligonucleotide
aaggagttagagccagggtc

SEQ ID NO: 5601 - DNA, 20 bp, Artificial Sequence
  Description of Artificial Sequence: Synthetic oligonucleotide
aggagttagagccagggtca

SEQ ID NO: 5602 - DNA, 20 bp, Artificial Sequence
  Description of Artificial Sequence: Synthetic oligonucleotide
ggagttagagccagggtcag

SEQ ID NO: 5603 - DNA, 20 bp, Artificial Sequence
  Description of Artificial Sequence: Synthetic oligonucleotide
gagttagagccagggtcaga

SEQ ID NO: 5604 - DNA, 20 bp, Artificial Sequence
  Description of Artificial Sequence: Synthetic oligonucleotide
agttagagccagggtcagaa

SEQ ID NO: 5605 - DNA, 20 bp, Artificial Sequence
  Description of Artificial Sequence: Synthetic oligonucleotide
gttagagccagggtcagaaa

SEQ ID NO: 5606 - DNA, 20 bp, Artificial Sequence
  Description of Artificial Sequence: Synthetic oligonucleotide
ttagagccagggtcagaaag

SEQ ID NO: 5607 - DNA, 20 bp, Artificial Sequence
  Description of Artificial Sequence: Synthetic oligonucleotide
tagagccagggtcagaaaga

SEQ ID NO: 5608 - DNA, 20 bp, Artificial Sequence
  Description of Artificial Sequence: Synthetic oligonucleotide
agagccagggtcagaaagaa

SEQ ID NO: 5609 - DNA, 20 bp, Artificial Sequence
  Description of Artificial Sequence: Synthetic oligonucleotide
gagccagggtcagaaagaat

SEQ ID NO: 5610 - DNA, 20 bp, Artificial Sequence
  Description of Artificial Sequence: Synthetic oligonucleotide
agccagggtcagaaagaata

SEQ ID NO: 5611 - DNA, 20 bp, Artificial Sequence
  Description of Artificial Sequence: Synthetic oligonucleotide
gccagggtcagaaagaatac

SEQ ID NO: 5612 - DNA, 20 bp, Artificial Sequence
  Description of Artificial Sequence: Synthetic oligonucleotide
ccagggtcagaaagaatacc

SEQ ID NO: 5613 - DNA, 20 bp, Artificial Sequence
  Description of Artificial Sequence: Synthetic oligonucleotide
cagggtcagaaagaatacca

SEQ ID NO: 5614 - DNA, 20 bp, Artificial Sequence
  Description of Artificial Sequence: Synthetic oligonucleotide
agggtcagaaagaataccaa

SEQ ID NO: 5615 - DNA, 20 bp, Artificial Sequence
  Description of Artificial Sequence: Synthetic oligonucleotide
gggtcagaaagaataccaaa

SEQ ID NO: 5616 - DNA, 20 bp, Artificial Sequence
  Description of Artificial Sequence: Synthetic oligonucleotide
ggtcagaaagaataccaaaa

SEQ ID NO: 5617 - DNA, 20 bp, Artificial Sequence
  Description of Artificial Sequence: Synthetic oligonucleotide
gtcagaaagaataccaaaac

SEQ ID NO: 5618 - DNA, 20 bp, Artificial Sequence
  Description of Artificial Sequence: Synthetic oligonucleotide
tcagaaagaataccaaaacc

SEQ ID NO: 5619 - DNA, 20 bp, Artificial Sequence
  Description of Artificial Sequence: Synthetic oligonucleotide
cagaaagaataccaaaaccg

SEQ ID NO: 5620 - DNA, 20 bp, Artificial Sequence
  Description of Artificial Sequence: Synthetic oligonucleotide
agaaagaataccaaaaccgg

SEQ ID NO: 5621 - DNA, 20 bp, Artificial Sequence
  Description of Artificial Sequence: Synthetic oligonucleotide
gaaagaataccaaaaccgga

SEQ ID NO: 5622 - DNA, 20 bp, Artificial Sequence
  Description of Artificial Sequence: Synthetic oligonucleotide
aaagaataccaaaaccggaa

SEQ ID NO: 5623 - DNA, 20 bp, Artificial Sequence
  Description of Artificial Sequence: Synthetic oligonucleotide
aagaataccaaaaccggaat

SEQ ID NO: 5624 - DNA, 20 bp, Artificial Sequence
  Description of Artificial Sequence: Synthetic oligonucleotide
agaataccaaaaccggaata

SEQ ID NO: 5625 - DNA, 20 bp, Artificial Sequence
  Description of Artificial Sequence: Synthetic oligonucleotide
gaataccaaaaccggaatat

SEQ ID NO: 5626 - DNA, 20 bp, Artificial Sequence
  Description of Artificial Sequence: Synthetic oligonucleotide
aataccaaaaccggaatatc

SEQ ID NO: 5627 - DNA, 20 bp, Artificial Sequence
  Description of Artificial Sequence: Synthetic oligonucleotide
ataccaaaaccggaatatca

SEQ ID NO: 5628 - DNA, 20 bp, Artificial Sequence
  Description of Artificial Sequence: Synthetic oligonucleotide
taccaaaaccggaatatcaa

SEQ ID NO: 5629 - DNA, 20 bp, Artificial Sequence
  Description of Artificial Sequence: Synthetic oligonucleotide
accaaaaccggaatatcaac

SEQ ID NO: 5630 - DNA, 20 bp, Artificial Sequence
  Description of Artificial Sequence: Synthetic oligonucleotide
ccaaaaccggaatatcaact

SEQ ID NO: 5631 - DNA, 20 bp, Artificial Sequence
  Description of Artificial Sequence: Synthetic oligonucleotide
caaaaccggaatatcaactg

SEQ ID NO: 5632 - DNA, 20 bp, Artificial Sequence
  Description of Artificial Sequence: Synthetic oligonucleotide
aaaaccggaatatcaactgt

SEQ ID NO: 5633 - DNA, 20 bp, Artificial Sequence
  Description of Artificial Sequence: Synthetic oligonucleotide
aaaccggaatatcaactgta

SEQ ID NO: 5634 - DNA, 20 bp, Artificial Sequence
  Description of Artificial Sequence: Synthetic oligonucleotide
aaccggaatatcaactgtac

SEQ ID NO: 5635 - DNA, 20 bp, Artificial Sequence
  Description of Artificial Sequence: Synthetic oligonucleotide
accggaatatcaactgtaca

SEQ ID NO: 5636 - DNA, 20 bp, Artificial Sequence
  Description of Artificial Sequence: Synthetic oligonucleotide
ccggaatatcaactgtacag

SEQ ID NO: 5637 - DNA, 20 bp, Artificial Sequence
  Description of Artificial Sequence: Synthetic oligonucleotide
cggaatatcaactgtacagt

SEQ ID NO: 5638 - DNA, 20 bp, Artificial Sequence
  Description of Artificial Sequence: Synthetic oligonucleotide
ggaatatcaactgtacagtt

SEQ ID NO: 5639 - DNA, 20 bp, Artificial Sequence
  Description of Artificial Sequence: Synthetic oligonucleotide
gaatatcaactgtacagtta

SEQ ID NO: 5640 - DNA, 20 bp, Artificial Sequence
  Description of Artificial Sequence: Synthetic oligonucleotide
aatatcaactgtacagttat

SEQ ID NO: 5641 - DNA, 20 bp, Artificial Sequence
  Description of Artificial Sequence: Synthetic oligonucleotide
atatcaactgtacagttata

SEQ ID NO: 5642 - DNA, 20 bp, Artificial Sequence
  Description of Artificial Sequence: Synthetic oligonucleotide
tatcaactgtacagttataa

SEQ ID NO: 5643 - DNA, 20 bp, Artificial Sequence
  Description of Artificial Sequence: Synthetic oligonucleotide
atcaactgtacagttataat

SEQ ID NO: 5644 - DNA, 20 bp, Artificial Sequence
  Description of Artificial Sequence: Synthetic oligonucleotide
tcaactgtacagttataatt

SEQ ID NO: 5645 - DNA, 20 bp, Artificial Sequence
  Description of Artificial Sequence: Synthetic oligonucleotide
caactgtacagttataattc

SEQ ID NO: 5646 - DNA, 20 bp, Artificial Sequence
  Description of Artificial Sequence: Synthetic oligonucleotide
aactgtacagttataattca

SEQ ID NO: 5647 - DNA, 20 bp, Artificial Sequence
  Description of Artificial Sequence: Synthetic oligonucleotide
actgtacagttataattcac

SEQ ID NO: 5648 - DNA, 20 bp, Artificial Sequence
  Description of Artificial Sequence: Synthetic oligonucleotide
ctgtacagttataattcact

SEQ ID NO: 5649 - DNA, 20 bp, Artificial Sequence
  Description of Artificial Sequence: Synthetic oligonucleotide
tgtacagttataattcactc

SEQ ID NO: 5650 - DNA, 20 bp, Artificial Sequence
  Description of Artificial Sequence: Synthetic oligonucleotide
gtacagttataattcactct

SEQ ID NO: 5651 - DNA, 20 bp, Artificial Sequence
  Description of Artificial Sequence: Synthetic oligonucleotide
tacagttataattcactctt

SEQ ID NO: 5652 - DNA, 20 bp, Artificial Sequence
  Description of Artificial Sequence: Synthetic oligonucleotide
acagttataattcactcttt

SEQ ID NO: 5653 - DNA, 20 bp, Artificial Sequence
  Description of Artificial Sequence: Synthetic oligonucleotide
cagttataattcactctttc

SEQ ID NO: 5654 - DNA, 20 bp, Artificial Sequence
  Description of Artificial Sequence: Synthetic oligonucleotide
agttataattcactctttct

SEQ ID NO: 5655 - DNA, 20 bp, Artificial Sequence
  Description of Artificial Sequence: Synthetic oligonucleotide
gttataattcactctttctc

SEQ ID NO: 5656 - DNA, 20 bp, Artificial Sequence
  Description of Artificial Sequence: Synthetic oligonucleotide
ttataattcactctttctcc

SEQ ID NO: 5657 - DNA, 20 bp, Artificial Sequence
  Description of Artificial Sequence: Synthetic oligonucleotide
tataattcactctttctcct

SEQ ID NO: 5658 - DNA, 20 bp, Artificial Sequence
  Description of Artificial Sequence: Synthetic oligonucleotide
ataattcactctttctcctc

SEQ ID NO: 5659 - DNA, 20 bp, Artificial Sequence
  Description of Artificial Sequence: Synthetic oligonucleotide
taattcactctttctcctca

SEQ ID NO: 5660 - DNA, 20 bp, Artificial Sequence
  Description of Artificial Sequence: Synthetic oligonucleotide
aattcactctttctcctcaa

SEQ ID NO: 5661 - DNA, 20 bp, Artificial Sequence
  Description of Artificial Sequence: Synthetic oligonucleotide
attcactctttctcctcaag

SEQ ID NO: 5662 - DNA, 20 bp, Artificial Sequence
  Description of Artificial Sequence: Synthetic oligonucleotide
ttcactctttctcctcaagt

SEQ ID NO: 5663 - DNA, 20 bp, Artificial Sequence
  Description of Artificial Sequence: Synthetic oligonucleotide
tcactctttctcctcaagtg

SEQ ID NO: 5664 - DNA, 20 bp, Artificial Sequence
  Description of Artificial Sequence: Synthetic oligonucleotide
cactctttctcctcaagtgg

SEQ ID NO: 5665 - DNA, 20 bp, Artificial Sequence
  Description of Artificial Sequence: Synthetic oligonucleotide
actctttctcctcaagtggg

SEQ ID NO: 5666 - DNA, 20 bp, Artificial Sequence
  Description of Artificial Sequence: Synthetic oligonucleotide
ctctttctcctcaagtggga

SEQ ID NO: 5667 - DNA, 20 bp, Artificial Sequence
  Description of Artificial Sequence: Synthetic oligonucleotide
tctttctcctcaagtgggat

SEQ ID NO: 5668 - DNA, 20 bp, Artificial Sequence
  Description of Artificial Sequence: Synthetic oligonucleotide
ctttctcctcaagtgggatt

SEQ ID NO: 5669 - DNA, 20 bp, Artificial Sequence
  Description of Artificial Sequence: Synthetic oligonucleotide
tttctcctcaagtgggatta

SEQ ID NO: 5670 - DNA, 20 bp, Artificial Sequence
  Description of Artificial Sequence: Synthetic oligonucleotide
ttctcctcaagtgggattat

SEQ ID NO: 5671 - DNA, 20 bp, Artificial Sequence
  Description of Artificial Sequence: Synthetic oligonucleotide
tctcctcaagtgggattatg

SEQ ID NO: 5672 - DNA, 20 bp, Artificial Sequence
  Description of Artificial Sequence: Synthetic oligonucleotide
ctcctcaagtgggattatga

SEQ ID NO: 5673 - DNA, 20 bp, Artificial Sequence
  Description of Artificial Sequence: Synthetic oligonucleotide
tcctcaagtgggattatgag

SEQ ID NO: 5674 - DNA, 20 bp, Artificial Sequence
  Description of Artificial Sequence: Synthetic oligonucleotide
cctcaagtgggattatgagc

SEQ ID NO: 5675 - DNA, 20 bp, Artificial Sequence
  Description of Artificial Sequence: Synthetic oligonucleotide
ctcaagtgggattatgagct

SEQ ID NO: 5676 - DNA, 20 bp, Artificial Sequence
  Description of Artificial Sequence: Synthetic oligonucleotide
tcaagtgggattatgagctt

SEQ ID NO: 5677 - DNA, 20 bp, Artificial Sequence
  Description of Artificial Sequence: Synthetic oligonucleotide
caagtgggattatgagcttg

SEQ ID NO: 5678 - DNA, 20 bp, Artificial Sequence
  Description of Artificial Sequence: Synthetic oligonucleotide
aagtgggattatgagcttgt

SEQ ID NO: 5679 - DNA, 20 bp, Artificial Sequence
  Description of Artificial Sequence: Synthetic oligonucleotide
agtgggattatgagcttgta

SEQ ID NO: 5680 - DNA, 20 bp, Artificial Sequence
  Description of Artificial Sequence: Synthetic oligonucleotide
gtgggattatgagcttgtac

SEQ ID NO: 5681 - DNA, 20 bp, Artificial Sequence
  Description of Artificial Sequence: Synthetic oligonucleotide
tgggattatgagcttgtacc

SEQ ID NO: 5682 - DNA, 20 bp, Artificial Sequence
  Description of Artificial Sequence: Synthetic oligonucleotide
gggattatgagcttgtacct

SEQ ID NO: 5683 - DNA, 20 bp, Artificial Sequence
  Description of Artificial Sequence: Synthetic oligonucleotide
ggattatgagcttgtacctg

SEQ ID NO: 5684 - DNA, 20 bp, Artificial Sequence
  Description of Artificial Sequence: Synthetic oligonucleotide
gattatgagcttgtacctga

SEQ ID NO: 5685 - DNA, 20 bp, Artificial Sequence
  Description of Artificial Sequence: Synthetic oligonucleotide
attatgagcttgtacctgaa

SEQ ID NO: 5686 - DNA, 20 bp, Artificial Sequence
  Description of Artificial Sequence: Synthetic oligonucleotide
ttatgagcttgtacctgaac

SEQ ID NO: 5687 - DNA, 20 bp, Artificial Sequence
  Description of Artificial Sequence: Synthetic oligonucleotide
tatgagcttgtacctgaact

SEQ ID NO: 5688 - DNA, 20 bp, Artificial Sequence
  Description of Artificial Sequence: Synthetic oligonucleotide
atgagcttgtacctgaactt

SEQ ID NO: 5689 - DNA, 20 bp, Artificial Sequence
  Description of Artificial Sequence: Synthetic oligonucleotide
tgagcttgtacctgaacttc

SEQ ID NO: 5690 - DNA, 20 bp, Artificial Sequence
  Description of Artificial Sequence: Synthetic oligonucleotide
gagcttgtacctgaacttct

SEQ ID NO: 5691 - DNA, 20 bp, Artificial Sequence
  Description of Artificial Sequence: Synthetic oligonucleotide
agcttgtacctgaacttctc

SEQ ID NO: 5692 - DNA, 20 bp, Artificial Sequence
  Description of Artificial Sequence: Synthetic oligonucleotide
gcttgtacctgaacttctcc

SEQ ID NO: 5693 - DNA, 20 bp, Artificial Sequence
  Description of Artificial Sequence: Synthetic oligonucleotide
cttgtacctgaacttctcct

SEQ ID NO: 5694 - DNA, 20 bp, Artificial Sequence
  Description of Artificial Sequence: Synthetic oligonucleotide
ttgtacctgaacttctcctt

SEQ ID NO: 5695 - DNA, 20 bp, Artificial Sequence
  Description of Artificial Sequence: Synthetic oligonucleotide
tgtacctgaacttctccttt

SEQ ID NO: 5696 - DNA, 20 bp, Artificial Sequence
  Description of Artificial Sequence: Synthetic oligonucleotide
gtacctgaacttctcctttc

SEQ ID NO: 5697 - DNA, 20 bp, Artificial Sequence
  Description of Artificial Sequence: Synthetic oligonucleotide
tacctgaacttctcctttcc

SEQ ID NO: 5698 - DNA, 20 bp, Artificial Sequence
  Description of Artificial Sequence: Synthetic oligonucleotide
acctgaacttctcctttccg

SEQ ID NO: 5699 - DNA, 20 bp, Artificial Sequence
  Description of Artificial Sequence: Synthetic oligonucleotide
cctgaacttctcctttccgg

SEQ ID NO: 5700 - DNA, 20 bp, Artificial Sequence
  Description of Artificial Sequence: Synthetic oligonucleotide
ctgaacttctcctttccggt

SEQ ID NO: 5701 - DNA, 20 bp, Artificial Sequence
  Description of Artificial Sequence: Synthetic oligonucleotide
tgaacttctcctttccggtc

SEQ ID NO: 5702 - DNA, 20 bp, Artificial Sequence
  Description of Artificial Sequence: Synthetic oligonucleotide
gaacttctcctttccggtcc

SEQ ID NO: 5703 - DNA, 20 bp, Artificial Sequence
  Description of Artificial Sequence: Synthetic oligonucleotide
aacttctcctttccggtccc

SEQ ID NO: 5704 - DNA, 20 bp, Artificial Sequence
  Description of Artificial Sequence: Synthetic oligonucleotide
acttctcctttccggtcccc

SEQ ID NO: 5705 - DNA, 20 bp, Artificial Sequence
  Description of Artificial Sequence: Synthetic oligonucleotide
cttctcctttccggtccccc

SEQ ID NO: 5706 - DNA, 20 bp, Artificial Sequence
  Description of Artificial Sequence: Synthetic oligonucleotide
ttctcctttccggtcccccc

SEQ ID NO: 5707 - DNA, 20 bp, Artificial Sequence
  Description of Artificial Sequence: Synthetic oligonucleotide
tctcctttccggtcccccca

SEQ ID NO: 5708 - DNA, 20 bp, Artificial Sequence
  Description of Artificial Sequence: Synthetic oligonucleotide
ctcctttccggtccccccaa

SEQ ID NO: 5709 - DNA, 20 bp, Artificial Sequence
  Description of Artificial Sequence: Synthetic oligonucleotide
tcctttccggtccccccaaa

SEQ ID NO: 5710 - DNA, 20 bp, Artificial Sequence
  Description of Artificial Sequence: Synthetic oligonucleotide
cctttccggtccccccaaat

SEQ ID NO: 5711 - DNA, 20 bp, Artificial Sequence
  Description of Artificial Sequence: Synthetic oligonucleotide
ctttccggtccccccaaatc

SEQ ID NO: 5712 - DNA, 20 bp, Artificial Sequence
  Description of Artificial Sequence: Synthetic oligonucleotide
tttccggtccccccaaatct

SEQ ID NO: 5713 - DNA, 20 bp, Artificial Sequence
  Description of Artificial Sequence: Synthetic oligonucleotide
ttccggtccccccaaatctc

SEQ ID NO: 5714 - DNA, 20 bp, Artificial Sequence
  Description of Artificial Sequence: Synthetic oligonucleotide
tccggtccccccaaatctca

SEQ ID NO: 5715 - DNA, 20 bp, Artificial Sequence
  Description of Artificial Sequence: Synthetic oligonucleotide
ccggtccccccaaatctcac

SEQ ID NO: 5716 - DNA, 20 bp, Artificial Sequence
  Description of Artificial Sequence: Synthetic oligonucleotide
cggtccccccaaatctcacc

SEQ ID NO: 5717 - DNA, 20 bp, Artificial Sequence
  Description of Artificial Sequence: Synthetic oligonucleotide
ggtccccccaaatctcacct

SEQ ID NO: 5718 - DNA, 20 bp, Artificial Sequence
  Description of Artificial Sequence: Synthetic oligonucleotide
gtccccccaaatctcacctt

SEQ ID NO: 5719 - DNA, 20 bp, Artificial Sequence
  Description of Artificial Sequence: Synthetic oligonucleotide
tccccccaaatctcaccttt

SEQ ID NO: 5720 - DNA, 20 bp, Artificial Sequence
  Description of Artificial Sequence: Synthetic oligonucleotide
ccccccaaatctcacctttg

SEQ ID NO: 5721 - DNA, 20 bp, Artificial Sequence
  Description of Artificial Sequence: Synthetic oligonucleotide
cccccaaatctcacctttgc

SEQ ID NO: 5722 - DNA, 20 bp, Artificial Sequence
  Description of Artificial Sequence: Synthetic oligonucleotide
ccccaaatctcacctttgcg

SEQ ID NO: 5723 - DNA, 20 bp, Artificial Sequence
  Description of Artificial Sequence: Synthetic oligonucleotide
cccaaatctcacctttgcgg

SEQ ID NO: 5724 - DNA, 20 bp, Artificial Sequence
  Description of Artificial Sequence: Synthetic oligonucleotide
ccaaatctcacctttgcgga

SEQ ID NO: 5725 - DNA, 20 bp, Artificial Sequence
  Description of Artificial Sequence: Synthetic oligonucleotide
caaatctcacctttgcggag

SEQ ID NO: 5726 - DNA, 20 bp, Artificial Sequence
  Description of Artificial Sequence: Synthetic oligonucleotide
aaatctcacctttgcggagc

SEQ ID NO: 5727 - DNA, 20 bp, Artificial Sequence
  Description of Artificial Sequence: Synthetic oligonucleotide
aatctcacctttgcggagct

SEQ ID NO: 5728 - DNA, 20 bp, Artificial Sequence
  Description of Artificial Sequence: Synthetic oligonucleotide
atctcacctttgcggagctg

SEQ ID NO: 5729 - DNA, 20 bp, Artificial Sequence
  Description of Artificial Sequence: Synthetic oligonucleotide
tctcacctttgcggagctgt

SEQ ID NO: 5730 - DNA, 20 bp, Artificial Sequence
  Description of Artificial Sequence: Synthetic oligonucleotide
ctcacctttgcggagctgtg

SEQ ID NO: 5731 - DNA, 20 bp, Artificial Sequence
  Description of Artificial Sequence: Synthetic oligonucleotide
tcacctttgcggagctgtgc

SEQ ID NO: 5732 - DNA, 20 bp, Artificial Sequence
  Description of Artificial Sequence: Synthetic oligonucleotide
cacctttgcggagctgtgca

SEQ ID NO: 5733 - DNA, 20 bp, Artificial Sequence
  Description of Artificial Sequence: Synthetic oligonucleotide
acctttgcggagctgtgcac

SEQ ID NO: 5734 - DNA, 20 bp, Artificial Sequence
  Description of Artificial Sequence: Synthetic oligonucleotide
cctttgcggagctgtgcaca

SEQ ID NO: 5735 - DNA, 20 bp, Artificial Sequence
  Description of Artificial Sequence: Synthetic oligonucleotide
ctttgcggagctgtgcacac

SEQ ID NO: 5736 - DNA, 20 bp, Artificial Sequence
  Description of Artificial Sequence: Synthetic oligonucleotide
tttgcggagctgtgcacact

SEQ ID NO: 5737 - DNA, 20 bp, Artificial Sequence
  Description of Artificial Sequence: Synthetic oligonucleotide
ttgcggagctgtgcacactt

SEQ ID NO: 5738 - DNA, 20 bp, Artificial Sequence
  Description of Artificial Sequence: Synthetic oligonucleotide
tgcggagctgtgcacacttg

SEQ ID NO: 5739 - DNA, 20 bp, Artificial Sequence
  Description of Artificial Sequence: Synthetic oligonucleotide
gcggagctgtgcacacttgt

SEQ ID NO: 5740 - DNA, 20 bp, Artificial Sequence
  Description of Artificial Sequence: Synthetic oligonucleotide
cggagctgtgcacacttgtc

SEQ ID NO: 5741 - DNA, 20 bp, Artificial Sequence
  Description of Artificial Sequence: Synthetic oligonucleotide
ggagctgtgcacacttgtcc

SEQ ID NO: 5742 - DNA, 20 bp, Artificial Sequence
  Description of Artificial Sequence: Synthetic oligonucleotide
gagctgtgcacacttgtcca

SEQ ID NO: 5743 - DNA, 20 bp, Artificial Sequence
  Description of Artificial Sequence: Synthetic oligonucleotide
agctgtgcacacttgtccaa

SEQ ID NO: 5744 - DNA, 20 bp, Artificial Sequence
  Description of Artificial Sequence: Synthetic oligonucleotide
gctgtgcacacttgtccaag

SEQ ID NO: 5745 - DNA, 20 bp, Artificial Sequence
  Description of Artificial Sequence: Synthetic oligonucleotide
ctgtgcacacttgtccaagc

SEQ ID NO: 5746 - DNA, 20 bp, Artificial Sequence
  Description of Artificial Sequence: Synthetic oligonucleotide
tgtgcacacttgtccaagca

SEQ ID NO: 5747 - DNA, 20 bp, Artificial Sequence
  Description of Artificial Sequence: Synthetic oligonucleotide
gtgcacacttgtccaagcag

SEQ ID NO: 5748 - DNA, 20 bp, Artificial Sequence
  Description of Artificial Sequence: Synthetic oligonucleotide
tgcacacttgtccaagcagt

SEQ ID NO: 5749 - DNA, 20 bp, Artificial Sequence
  Description of Artificial Sequence: Synthetic oligonucleotide
gcacacttgtccaagcagtt

SEQ ID NO: 5750 - DNA, 20 bp, Artificial Sequence
  Description of Artificial Sequence: Synthetic oligonucleotide
cacacttgtccaagcagttg

SEQ ID NO: 5751 - DNA, 20 bp, Artificial Sequence
  Description of Artificial Sequence: Synthetic oligonucleotide
acacttgtccaagcagttgt

SEQ ID NO: 5752 - DNA, 20 bp, Artificial Sequence
  Description of Artificial Sequence: Synthetic oligonucleotide
cacttgtccaagcagttgtc

SEQ ID NO: 5753 - DNA, 20 bp, Artificial Sequence
  Description of Artificial Sequence: Synthetic oligonucleotide
acttgtccaagcagttgtca

SEQ ID NO: 5754 - DNA, 20 bp, Artificial Sequence
  Description of Artificial Sequence: Synthetic oligonucleotide
cttgtccaagcagttgtcat

SEQ ID NO: 5755 - DNA, 20 bp, Artificial Sequence
  Description of Artificial Sequence: Synthetic oligonucleotide
ttgtccaagcagttgtcatt

SEQ ID NO: 5756 - DNA, 20 bp, Artificial Sequence
  Description of Artificial Sequence: Synthetic oligonucleotide
tgtccaagcagttgtcattg

SEQ ID NO: 5757 - DNA, 20 bp, Artificial Sequence
  Description of Artificial Sequence: Synthetic oligonucleotide
gtccaagcagttgtcattgt

SEQ ID NO: 5758 - DNA, 20 bp, Artificial Sequence
  Description of Artificial Sequence: Synthetic oligonucleotide
tccaagcagttgtcattgtc

SEQ ID NO: 5759 - DNA, 20 bp, Artificial Sequence
  Description of Artificial Sequence: Synthetic oligonucleotide
ccaagcagttgtcattgtcc

SEQ ID NO: 5760 - DNA, 20 bp, Artificial Sequence
  Description of Artificial Sequence: Synthetic oligonucleotide
caagcagttgtcattgtcct

SEQ ID NO: 5761 - DNA, 20 bp, Artificial Sequence
  Description of Artificial Sequence: Synthetic oligonucleotide
aagcagttgtcattgtcctt

SEQ ID NO: 5762 - DNA, 20 bp, Artificial Sequence
  Description of Artificial Sequence: Synthetic oligonucleotide
agcagttgtcattgtccttg

SEQ ID NO: 5763 - DNA, 20 bp, Artificial Sequence
  Description of Artificial Sequence: Synthetic oligonucleotide
gcagttgtcattgtccttgt

SEQ ID NO: 5764 - DNA, 20 bp, Artificial Sequence
  Description of Artificial Sequence: Synthetic oligonucleotide
cagttgtcattgtccttgtc

SEQ ID NO: 5765 - DNA, 20 bp, Artificial Sequence
  Description of Artificial Sequence: Synthetic oligonucleotide
agttgtcattgtccttgtcc

SEQ ID NO: 5766 - DNA, 20 bp, Artificial Sequence
  Description of Artificial Sequence: Synthetic oligonucleotide
gttgtcattgtccttgtcct

SEQ ID NO: 5767 - DNA, 20 bp, Artificial Sequence
  Description of Artificial Sequence: Synthetic oligonucleotide
ttgtcattgtccttgtcctt

SEQ ID NO: 5768 - DNA, 20 bp, Artificial Sequence
  Description of Artificial Sequence: Synthetic oligonucleotide
tgtcattgtccttgtccttg

SEQ ID NO: 5769 - DNA, 20 bp, Artificial Sequence
  Description of Artificial Sequence: Synthetic oligonucleotide
gtcattgtccttgtccttgg

SEQ ID NO: 5770 - DNA, 20 bp, Artificial Sequence
  Description of Artificial Sequence: Synthetic oligonucleotide
tcattgtccttgtccttggt

SEQ ID NO: 5771 - DNA, 20 bp, Artificial Sequence
  Description of Artificial Sequence: Synthetic oligonucleotide
cattgtccttgtccttggtg

SEQ ID NO: 5772 - DNA, 20 bp, Artificial Sequence
  Description of Artificial Sequence: Synthetic oligonucleotide
attgtccttgtccttggtgc

SEQ ID NO: 5773 - DNA, 20 bp, Artificial Sequence
  Description of Artificial Sequence: Synthetic oligonucleotide
ttgtccttgtccttggtgct

SEQ ID NO: 5774 - DNA, 20 bp, Artificial Sequence
  Description of Artificial Sequence: Synthetic oligonucleotide
tgtccttgtccttggtgctg

SEQ ID NO: 5775 - DNA, 20 bp, Artificial Sequence
  Description of Artificial Sequence: Synthetic oligonucleotide
gtccttgtccttggtgctga

SEQ ID NO: 5776 - DNA, 20 bp, Artificial Sequence
  Description of Artificial Sequence: Synthetic oligonucleotide
tccttgtccttggtgctgaa

SEQ ID NO: 5777 - DNA, 20 bp, Artificial Sequence
  Description of Artificial Sequence: Synthetic oligonucleotide
ccttgtccttggtgctgaag

SEQ ID NO: 5778 - DNA, 20 bp, Artificial Sequence
  Description of Artificial Sequence: Synthetic oligonucleotide
cttgtccttggtgctgaagg

SEQ ID NO: 5779 - DNA, 20 bp, Artificial Sequence
  Description of Artificial Sequence: Synthetic oligonucleotide
ttgtccttggtgctgaaggc

SEQ ID NO: 5780 - DNA, 20 bp, Artificial Sequence
  Description of Artificial Sequence: Synthetic oligonucleotide
tgtccttggtgctgaaggct

SEQ ID NO: 5781 - DNA, 20 bp, Artificial Sequence
  Description of Artificial Sequence: Synthetic oligonucleotide
gtccttggtgctgaaggctg

SEQ ID NO: 5782 - DNA, 20 bp, Artificial Sequence
  Description of Artificial Sequence: Synthetic oligonucleotide
tccttggtgctgaaggctgt

SEQ ID NO: 5783 - DNA, 20 bp, Artificial Sequence
  Description of Artificial Sequence: Synthetic oligonucleotide
ccttggtgctgaaggctgtg

SEQ ID NO: 5784 - DNA, 20 bp, Artificial Sequence
  Description of Artificial Sequence: Synthetic oligonucleotide
cttggtgctgaaggctgtgt

SEQ ID NO: 5785 - DNA, 20 bp, Artificial Sequence
  Description of Artificial Sequence: Synthetic oligonucleotide
ttggtgctgaaggctgtgtt

SEQ ID NO: 5786 - DNA, 20 bp, Artificial Sequence
  Description of Artificial Sequence: Synthetic oligonucleotide
tggtgctgaaggctgtgttg

SEQ ID NO: 5787 - DNA, 20 bp, Artificial Sequence
  Description of Artificial Sequence: Synthetic oligonucleotide
ggtgctgaaggctgtgttgt

SEQ ID NO: 5788 - DNA, 20 bp, Artificial Sequence
  Description of Artificial Sequence: Synthetic oligonucleotide
gtgctgaaggctgtgttgtt

SEQ ID NO: 5789 - DNA, 20 bp, Artificial Sequence
  Description of Artificial Sequence: Synthetic oligonucleotide
tgctgaaggctgtgttgtta

SEQ ID NO: 5790 - DNA, 20 bp, Artificial Sequence
  Description of Artificial Sequence: Synthetic oligonucleotide
gctgaaggctgtgttgttat

SEQ ID NO: 5791 - DNA, 20 bp, Artificial Sequence
  Description of Artificial Sequence: Synthetic oligonucleotide
ctgaaggctgtgttgttatg

SEQ ID NO: 5792 - DNA, 20 bp, Artificial Sequence
  Description of Artificial Sequence: Synthetic oligonucleotide
tgaaggctgtgttgttatga

SEQ ID NO: 5793 - DNA, 20 bp, Artificial Sequence
  Description of Artificial Sequence: Synthetic oligonucleotide
gaaggctgtgttgttatgat

SEQ ID NO: 5794 - DNA, 20 bp, Artificial Sequence
  Description of Artificial Sequence: Synthetic oligonucleotide
aaggctgtgttgttatgata

SEQ ID NO: 5795 - DNA, 20 bp, Artificial Sequence
  Description of Artificial Sequence: Synthetic oligonucleotide
aggctgtgttgttatgatac

SEQ ID NO: 5796 - DNA, 20 bp, Artificial Sequence
  Description of Artificial Sequence: Synthetic oligonucleotide
ggctgtgttgttatgatact

SEQ ID NO: 5797 - DNA, 20 bp, Artificial Sequence
  Description of Artificial Sequence: Synthetic oligonucleotide
gctgtgttgttatgatactg

SEQ ID NO: 5798 - DNA, 20 bp, Artificial Sequence
  Description of Artificial Sequence: Synthetic oligonucleotide
ctgtgttgttatgatactgg

SEQ ID NO: 5799 - DNA, 20 bp, Artificial Sequence
  Description of Artificial Sequence: Synthetic oligonucleotide
tgtgttgttatgatactgga

SEQ ID NO: 5800 - DNA, 20 bp, Artificial Sequence
  Description of Artificial Sequence: Synthetic oligonucleotide
gtgttgttatgatactggag

SEQ ID NO: 5801 - DNA, 20 bp, Artificial Sequence
  Description of Artificial Sequence: Synthetic oligonucleotide
tgttgttatgatactggagg

SEQ ID NO: 5802 - DNA, 20 bp, Artificial Sequence
  Description of Artificial Sequence: Synthetic oligonucleotide
gttgttatgatactggaggg

SEQ ID NO: 5803 - DNA, 20 bp, Artificial Sequence
  Description of Artificial Sequence: Synthetic oligonucleotide
ttgttatgatactggagggc

SEQ ID NO: 5804 - DNA, 20 bp, Artificial Sequence
  Description of Artificial Sequence: Synthetic oligonucleotide
tgttatgatactggagggcg

SEQ ID NO: 5805 - DNA, 20 bp, Artificial Sequence
  Description of Artificial Sequence: Synthetic oligonucleotide
gttatgatactggagggcgt

SEQ ID NO: 5806 - DNA, 20 bp, Artificial Sequence
  Description of Artificial Sequence: Synthetic oligonucleotide
ttatgatactggagggcgtc

SEQ ID NO: 5807 - DNA, 20 bp, Artificial Sequence
  Description of Artificial Sequence: Synthetic oligonucleotide
tatgatactggagggcgtcg

SEQ ID NO: 5808 - DNA, 20 bp, Artificial Sequence
  Description of Artificial Sequence: Synthetic oligonucleotide
atgatactggagggcgtcgt

SEQ ID NO: 5809 - DNA, 20 bp, Artificial Sequence
  Description of Artificial Sequence: Synthetic oligonucleotide
tgatactggagggcgtcgtt

SEQ ID NO: 5810 - DNA, 20 bp, Artificial Sequence
  Description of Artificial Sequence: Synthetic oligonucleotide
gatactggagggcgtcgttc

SEQ ID NO: 5811 - DNA, 20 bp, Artificial Sequence
  Description of Artificial Sequence: Synthetic oligonucleotide
atactggagggcgtcgttcc

SEQ ID NO: 5812 - DNA, 20 bp, Artificial Sequence
  Description of Artificial Sequence: Synthetic oligonucleotide
tactggagggcgtcgttccc

SEQ ID NO: 5813 - DNA, 20 bp, Artificial Sequence
  Description of Artificial Sequence: Synthetic oligonucleotide
actggagggcgtcgttcccc

SEQ ID NO: 5814 - DNA, 20 bp, Artificial Sequence
  Description of Artificial Sequence: Synthetic oligonucleotide
ctggagggcgtcgttcccca

SEQ ID NO: 5815 - DNA, 20 bp, Artificial Sequence
  Description of Artificial Sequence: Synthetic oligonucleotide
tggagggcgtcgttccccac

SEQ ID NO: 5816 - DNA, 20 bp, Artificial Sequence
  Description of Artificial Sequence: Synthetic oligonucleotide
ggagggcgtcgttccccaca

SEQ ID NO: 5817 - DNA, 20 bp, Artificial Sequence
  Description of Artificial Sequence: Synthetic oligonucleotide
gagggcgtcgttccccacat

SEQ ID NO: 5818 - DNA, 20 bp, Artificial Sequence
  Description of Artificial Sequence: Synthetic oligonucleotide
agggcgtcgttccccacatt

SEQ ID NO: 5819 - DNA, 20 bp, Artificial Sequence
  Description of Artificial Sequence: Synthetic oligonucleotide
gggcgtcgttccccacattg

SEQ ID NO: 5820 - DNA, 20 bp, Artificial Sequence
  Description of Artificial Sequence: Synthetic oligonucleotide
ggcgtcgttccccacattgc

SEQ ID NO: 5821 - DNA, 20 bp, Artificial Sequence
  Description of Artificial Sequence: Synthetic oligonucleotide
gcgtcgttccccacattgcc

SEQ ID NO: 5822 - DNA, 20 bp, Artificial Sequence
  Description of Artificial Sequence: Synthetic oligonucleotide
cgtcgttccccacattgcca

SEQ ID NO: 5823 - DNA, 20 bp, Artificial Sequence
  Description of Artificial Sequence: Synthetic oligonucleotide
gtcgttccccacattgccag

SEQ ID NO: 5824 - DNA, 20 bp, Artificial Sequence
  Description of Artificial Sequence: Synthetic oligonucleotide
tcgttccccacattgccagt

SEQ ID NO: 5825 - DNA, 20 bp, Artificial Sequence
  Description of Artificial Sequence: Synthetic oligonucleotide
cgttccccacattgccagtg

SEQ ID NO: 5826 - DNA, 20 bp, Artificial Sequence
  Description of Artificial Sequence: Synthetic oligonucleotide
gttccccacattgccagtgt

SEQ ID NO: 5827 - DNA, 20 bp, Artificial Sequence
  Description of Artificial Sequence: Synthetic oligonucleotide
ttccccacattgccagtgta

SEQ ID NO: 5828 - DNA, 20 bp, Artificial Sequence
  Description of Artificial Sequence: Synthetic oligonucleotide
tccccacattgccagtgtag

SEQ ID NO: 5829 - DNA, 20 bp, Artificial Sequence
  Description of Artificial Sequence: Synthetic oligonucleotide
ccccacattgccagtgtagt

SEQ ID NO: 5830 - DNA, 20 bp, Artificial Sequence
  Description of Artificial Sequence: Synthetic oligonucleotide
cccacattgccagtgtagtt

SEQ ID NO: 5831 - DNA, 20 bp, Artificial Sequence
  Description of Artificial Sequence: Synthetic oligonucleotide
ccacattgccagtgtagttc

SEQ ID NO: 5832 - DNA, 20 bp, Artificial Sequence
  Description of Artificial Sequence: Synthetic oligonucleotide
cacattgccagtgtagttcc

SEQ ID NO: 5833 - DNA, 20 bp, Artificial Sequence
  Description of Artificial Sequence: Synthetic oligonucleotide
acattgccagtgtagttccc

SEQ ID NO: 5834 - DNA, 20 bp, Artificial Sequence
  Description of Artificial Sequence: Synthetic oligonucleotide
cattgccagtgtagttcccc

SEQ ID NO: 5835 - DNA, 20 bp, Artificial Sequence
  Description of Artificial Sequence: Synthetic oligonucleotide
attgccagtgtagttcccca

SEQ ID NO: 5836 - DNA, 20 bp, Artificial Sequence
  Description of Artificial Sequence: Synthetic oligonucleotide
ttgccagtgtagttccccag

SEQ ID NO: 5837 - DNA, 20 bp, Artificial Sequence
  Description of Artificial Sequence: Synthetic oligonucleotide
tgccagtgtagttccccagg

SEQ ID NO: 5838 - DNA, 20 bp, Artificial Sequence
  Description of Artificial Sequence: Synthetic oligonucleotide
gccagtgtagttccccagga

SEQ ID NO: 5839 - DNA, 20 bp, Artificial Sequence
  Description of Artificial Sequence: Synthetic oligonucleotide
ccagtgtagttccccaggaa

SEQ ID NO: 5840 - DNA, 20 bp, Artificial Sequence
  Description of Artificial Sequence: Synthetic oligonucleotide
cagtgtagttccccaggaag

SEQ ID NO: 5841 - DNA, 20 bp, Artificial Sequence
  Description of Artificial Sequence: Synthetic oligonucleotide
agtgtagttccccaggaaga

SEQ ID NO: 5842 - DNA, 20 bp, Artificial Sequence
  Description of Artificial Sequence: Synthetic oligonucleotide
gtgtagttccccaggaagag

SEQ ID NO: 5843 - DNA, 20 bp, Artificial Sequence
  Description of Artificial Sequence: Synthetic oligonucleotide
tgtagttccccaggaagagg

SEQ ID NO: 5844 - DNA, 20 bp, Artificial Sequence
  Description of Artificial Sequence: Synthetic oligonucleotide
gtagttccccaggaagaggc

SEQ ID NO: 5845 - DNA, 20 bp, Artificial Sequence
  Description of Artificial Sequence: Synthetic oligonucleotide
tagttccccaggaagaggcg

SEQ ID NO: 5846 - DNA, 20 bp, Artificial Sequence
  Description of Artificial Sequence: Synthetic oligonucleotide
agttccccaggaagaggcga

SEQ ID NO: 5847 - DNA, 20 bp, Artificial Sequence
  Description of Artificial Sequence: Synthetic oligonucleotide
gttccccaggaagaggcgat

SEQ ID NO: 5848 - DNA, 20 bp, Artificial Sequence
  Description of Artificial Sequence: Synthetic oligonucleotide
ttccccaggaagaggcgata

SEQ ID NO: 5849 - DNA, 20 bp, Artificial Sequence
  Description of Artificial Sequence: Synthetic oligonucleotide
tccccaggaagaggcgatag

SEQ ID NO: 5850 - DNA, 20 bp, Artificial Sequence
  Description of Artificial Sequence: Synthetic oligonucleotide
ccccaggaagaggcgatagc

SEQ ID NO: 5851 - DNA, 20 bp, Artificial Sequence
  Description of Artificial Sequence: Synthetic oligonucleotide
cccaggaagaggcgatagct

SEQ ID NO: 5852 - DNA, 20 bp, Artificial Sequence
  Description of Artificial Sequence: Synthetic oligonucleotide
ccaggaagaggcgatagctg

SEQ ID NO: 5853 - DNA, 20 bp, Artificial Sequence
  Description of Artificial Sequence: Synthetic oligonucleotide
caggaagaggcgatagctgt

SEQ ID NO: 5854 - DNA, 20 bp, Artificial Sequence
  Description of Artificial Sequence: Synthetic oligonucleotide
aggaagaggcgatagctgtt

SEQ ID NO: 5855 - DNA, 20 bp, Artificial Sequence
  Description of Artificial Sequence: Synthetic oligonucleotide
ggaagaggcgatagctgttg

SEQ ID NO: 5856 - DNA, 20 bp, Artificial Sequence
  Description of Artificial Sequence: Synthetic oligonucleotide
gaagaggcgatagctgttga

SEQ ID NO: 5857 - DNA, 20 bp, Artificial Sequence
  Description of Artificial Sequence: Synthetic oligonucleotide
aagaggcgatagctgttgag

SEQ ID NO: 5858 - DNA, 20 bp, Artificial Sequence
  Description of Artificial Sequence: Synthetic oligonucleotide
agaggcgatagctgttgagt

SEQ ID NO: 5859 - DNA, 20 bp, Artificial Sequence
  Description of Artificial Sequence: Synthetic oligonucleotide
gaggcgatagctgttgagtt

SEQ ID NO: 5860 - DNA, 20 bp, Artificial Sequence
  Description of Artificial Sequence: Synthetic oligonucleotide
aggcgatagctgttgagttc

SEQ ID NO: 5861 - DNA, 20 bp, Artificial Sequence
  Description of Artificial Sequence: Synthetic oligonucleotide
ggcgatagctgttgagttca

SEQ ID NO: 5862 - DNA, 20 bp, Artificial Sequence
  Description of Artificial Sequence: Synthetic oligonucleotide
gcgatagctgttgagttcat

SEQ ID NO: 5863 - DNA, 20 bp, Artificial Sequence
  Description of Artificial Sequence: Synthetic oligonucleotide
cgatagctgttgagttcatt

SEQ ID NO: 5864 - DNA, 20 bp, Artificial Sequence
  Description of Artificial Sequence: Synthetic oligonucleotide
gatagctgttgagttcattg

SEQ ID NO: 5865 - DNA, 20 bp, Artificial Sequence
  Description of Artificial Sequence: Synthetic oligonucleotide
atagctgttgagttcattgc

SEQ ID NO: 5866 - DNA, 20 bp, Artificial Sequence
  Description of Artificial Sequence: Synthetic oligonucleotide
tagctgttgagttcattgcc

SEQ ID NO: 5867 - DNA, 20 bp, Artificial Sequence
  Description of Artificial Sequence: Synthetic oligonucleotide
agctgttgagttcattgccc

SEQ ID NO: 5868 - DNA, 20 bp, Artificial Sequence
  Description of Artificial Sequence: Synthetic oligonucleotide
gctgttgagttcattgccca

SEQ ID NO: 5869 - DNA, 20 bp, Artificial Sequence
  Description of Artificial Sequence: Synthetic oligonucleotide
ctgttgagttcattgcccaa

SEQ ID NO: 5870 - DNA, 20 bp, Artificial Sequence
  Description of Artificial Sequence: Synthetic oligonucleotide
tgttgagttcattgcccaaa

SEQ ID NO: 5871 - DNA, 20 bp, Artificial Sequence
  Description of Artificial Sequence: Synthetic oligonucleotide
gttgagttcattgcccaaaa

SEQ ID NO: 5872 - DNA, 20 bp, Artificial Sequence
  Description of Artificial Sequence: Synthetic oligonucleotide
ttgagttcattgcccaaaac

SEQ ID NO: 5873 - DNA, 20 bp, Artificial Sequence
  Description of Artificial Sequence: Synthetic oligonucleotide
tgagttcattgcccaaaaca

SEQ ID NO: 5874 - DNA, 20 bp, Artificial Sequence
  Description of Artificial Sequence: Synthetic oligonucleotide
gagttcattgcccaaaacaa

SEQ ID NO: 5875 - DNA, 20 bp, Artificial Sequence
  Description of Artificial Sequence: Synthetic oligonucleotide
agttcattgcccaaaacaaa

SEQ ID NO: 5876 - DNA, 20 bp, Artificial Sequence
  Description of Artificial Sequence: Synthetic oligonucleotide
gttcattgcccaaaacaaag

SEQ ID NO: 5877 - DNA, 20 bp, Artificial Sequence
  Description of Artificial Sequence: Synthetic oligonucleotide
ttcattgcccaaaacaaagt

SEQ ID NO: 5878 - DNA, 20 bp, Artificial Sequence
  Description of Artificial Sequence: Synthetic oligonucleotide
tcattgcccaaaacaaagtg

SEQ ID NO: 5879 - DNA, 20 bp, Artificial Sequence
  Description of Artificial Sequence: Synthetic oligonucleotide
cattgcccaaaacaaagtgg

SEQ ID NO: 5880 - DNA, 20 bp, Artificial Sequence
  Description of Artificial Sequence: Synthetic oligonucleotide
attgcccaaaacaaagtggc

SEQ ID NO: 5881 - DNA, 20 bp, Artificial Sequence
  Description of Artificial Sequence: Synthetic oligonucleotide
ttgcccaaaacaaagtggct

SEQ ID NO: 5882 - DNA, 20 bp, Artificial Sequence
  Description of Artificial Sequence: Synthetic oligonucleotide
tgcccaaaacaaagtggcta

SEQ ID NO: 5883 - DNA, 20 bp, Artificial Sequence
  Description of Artificial Sequence: Synthetic oligonucleotide
gcccaaaacaaagtggctat

SEQ ID NO: 5884 - DNA, 20 bp, Artificial Sequence
  Description of Artificial Sequence: Synthetic oligonucleotide
cccaaaacaaagtggctata

SEQ ID NO: 5885 - DNA, 20 bp, Artificial Sequence
  Description of Artificial Sequence: Synthetic oligonucleotide
ccaaaacaaagtggctatac

SEQ ID NO: 5886 - DNA, 20 bp, Artificial Sequence
  Description of Artificial Sequence: Synthetic oligonucleotide
caaaacaaagtggctatact

SEQ ID NO: 5887 - DNA, 20 bp, Artificial Sequence
  Description of Artificial Sequence: Synthetic oligonucleotide
aaaacaaagtggctatactc

SEQ ID NO: 5888 - DNA, 20 bp, Artificial Sequence
  Description of Artificial Sequence: Synthetic oligonucleotide
aaacaaagtggctatactca

SEQ ID NO: 5889 - DNA, 20 bp, Artificial Sequence
  Description of Artificial Sequence: Synthetic oligonucleotide
aacaaagtggctatactcag

SEQ ID NO: 5890 - DNA, 20 bp, Artificial Sequence
  Description of Artificial Sequence: Synthetic oligonucleotide
acaaagtggctatactcagc

SEQ ID NO: 5891 - DNA, 20 bp, Artificial Sequence
  Description of Artificial Sequence: Synthetic oligonucleotide
caaagtggctatactcagcg

SEQ ID NO: 5892 - DNA, 20 bp, Artificial Sequence
  Description of Artificial Sequence: Synthetic oligonucleotide
aaagtggctatactcagcgt

SEQ ID NO: 5893 - DNA, 20 bp, Artificial Sequence
  Description of Artificial Sequence: Synthetic oligonucleotide
aagtggctatactcagcgta

SEQ ID NO: 5894 - DNA, 20 bp, Artificial Sequence
  Description of Artificial Sequence: Synthetic oligonucleotide
agtggctatactcagcgtag

SEQ ID NO: 5895 - DNA, 20 bp, Artificial Sequence
  Description of Artificial Sequence: Synthetic oligonucleotide
gtggctatactcagcgtagc

SEQ ID NO: 5896 - DNA, 20 bp, Artificial Sequence
  Description of Artificial Sequence: Synthetic oligonucleotide
tggctatactcagcgtagcg

SEQ ID NO: 5897 - DNA, 20 bp, Artificial Sequence
  Description of Artificial Sequence: Synthetic oligonucleotide
ggctatactcagcgtagcgc

SEQ ID NO: 5898 - DNA, 20 bp, Artificial Sequence
  Description of Artificial Sequence: Synthetic oligonucleotide
gctatactcagcgtagcgca

SEQ ID NO: 5899 - DNA, 20 bp, Artificial Sequence
  Description of Artificial Sequence: Synthetic oligonucleotide
ctatactcagcgtagcgcag

SEQ ID NO: 5900 - DNA, 20 bp, Artificial Sequence
  Description of Artificial Sequence: Synthetic oligonucleotide
tatactcagcgtagcgcagg

SEQ ID NO: 5901 - DNA, 20 bp, Artificial Sequence
  Description of Artificial Sequence: Synthetic oligonucleotide
atactcagcgtagcgcaggt

SEQ ID NO: 5902 - DNA, 20 bp, Artificial Sequence
  Description of Artificial Sequence: Synthetic oligonucleotide
tactcagcgtagcgcaggtt

SEQ ID NO: 5903 - DNA, 20 bp, Artificial Sequence
  Description of Artificial Sequence: Synthetic oligonucleotide
actcagcgtagcgcaggttg

SEQ ID NO: 5904 - DNA, 20 bp, Artificial Sequence
  Description of Artificial Sequence: Synthetic oligonucleotide
ctcagcgtagcgcaggttgc

SEQ ID NO: 5905 - DNA, 20 bp, Artificial Sequence
  Description of Artificial Sequence: Synthetic oligonucleotide
tcagcgtagcgcaggttgcc

SEQ ID NO: 5906 - DNA, 20 bp, Artificial Sequence
  Description of Artificial Sequence: Synthetic oligonucleotide
cagcgtagcgcaggttgccc

SEQ ID NO: 5907 - DNA, 20 bp, Artificial Sequence
  Description of Artificial Sequence: Synthetic oligonucleotide
agcgtagcgcaggttgccct

SEQ ID NO: 5908 - DNA, 20 bp, Artificial Sequence
  Description of Artificial Sequence: Synthetic oligonucleotide
gcgtagcgcaggttgccctc

SEQ ID NO: 5909 - DNA, 20 bp, Artificial Sequence
  Description of Artificial Sequence: Synthetic oligonucleotide
cgtagcgcaggttgccctcc

SEQ ID NO: 5910 - DNA, 20 bp, Artificial Sequence
  Description of Artificial Sequence: Synthetic oligonucleotide
gtagcgcaggttgccctccc

SEQ ID NO: 5911 - DNA, 20 bp, Artificial Sequence
  Description of Artificial Sequence: Synthetic oligonucleotide
tagcgcaggttgccctccca

SEQ ID NO: 5912 - DNA, 20 bp, Artificial Sequence
  Description of Artificial Sequence: Synthetic oligonucleotide
agcgcaggttgccctcccag

SEQ ID NO: 5913 - DNA, 20 bp, Artificial Sequence
  Description of Artificial Sequence: Synthetic oligonucleotide
gcgcaggttgccctcccagt

SEQ ID NO: 5914 - DNA, 20 bp, Artificial Sequence
  Description of Artificial Sequence: Synthetic oligonucleotide
cgcaggttgccctcccagtc

SEQ ID NO: 5915 - DNA, 20 bp, Artificial Sequence
  Description of Artificial Sequence: Synthetic oligonucleotide
gcaggttgccctcccagtcc

SEQ ID NO: 5916 - DNA, 20 bp, Artificial Sequence
  Description of Artificial Sequence: Synthetic oligonucleotide
caggttgccctcccagtcct

SEQ ID NO: 5917 - DNA, 20 bp, Artificial Sequence
  Description of Artificial Sequence: Synthetic oligonucleotide
aggttgccctcccagtcctg

SEQ ID NO: 5918 - DNA, 20 bp, Artificial Sequence
  Description of Artificial Sequence: Synthetic oligonucleotide
ggttgccctcccagtcctgt

SEQ ID NO: 5919 - DNA, 20 bp, Artificial Sequence
  Description of Artificial Sequence: Synthetic oligonucleotide
gttgccctcccagtcctgtc

SEQ ID NO: 5920 - DNA, 20 bp, Artificial Sequence
  Description of Artificial Sequence: Synthetic oligonucleotide
ttgccctcccagtcctgtca

SEQ ID NO: 5921 - DNA, 20 bp, Artificial Sequence
  Description of Artificial Sequence: Synthetic oligonucleotide
tgccctcccagtcctgtcag

SEQ ID NO: 5922 - DNA, 20 bp, Artificial Sequence
  Description of Artificial Sequence: Synthetic oligonucleotide
gccctcccagtcctgtcagg

SEQ ID NO: 5923 - DNA, 20 bp, Artificial Sequence
  Description of Artificial Sequence: Synthetic oligonucleotide
ccctcccagtcctgtcagga

SEQ ID NO: 5924 - DNA, 20 bp, Artificial Sequence
  Description of Artificial Sequence: Synthetic oligonucleotide
cctcccagtcctgtcaggag

SEQ ID NO: 5925 - DNA, 20 bp, Artificial Sequence
  Description of Artificial Sequence: Synthetic oligonucleotide
ctcccagtcctgtcaggagg

SEQ ID NO: 5926 - DNA, 20 bp, Artificial Sequence
  Description of Artificial Sequence: Synthetic oligonucleotide
tcccagtcctgtcaggagga

SEQ ID NO: 5927 - DNA, 20 bp, Artificial Sequence
  Description of Artificial Sequence: Synthetic oligonucleotide
cccagtcctgtcaggaggag

SEQ ID NO: 5928 - DNA, 20 bp, Artificial Sequence
  Description of Artificial Sequence: Synthetic oligonucleotide
ccagtcctgtcaggaggagc

SEQ ID NO: 5929 - DNA, 20 bp, Artificial Sequence
  Description of Artificial Sequence: Synthetic oligonucleotide
cagtcctgtcaggaggagca

SEQ ID NO: 5930 - DNA, 20 bp, Artificial Sequence
  Description of Artificial Sequence: Synthetic oligonucleotide
agtcctgtcaggaggagcag

SEQ ID NO: 5931 - DNA, 20 bp, Artificial Sequence
  Description of Artificial Sequence: Synthetic oligonucleotide
gtcctgtcaggaggagcaga

SEQ ID NO: 5932 - DNA, 20 bp, Artificial Sequence
  Description of Artificial Sequence: Synthetic oligonucleotide
tcctgtcaggaggagcagag

SEQ ID NO: 5933 - DNA, 20 bp, Artificial Sequence
  Description of Artificial Sequence: Synthetic oligonucleotide
cctgtcaggaggagcagagc

SEQ ID NO: 5934 - DNA, 20 bp, Artificial Sequence
  Description of Artificial Sequence: Synthetic oligonucleotide
ctgtcaggaggagcagagcc

SEQ ID NO: 5935 - DNA, 20 bp, Artificial Sequence
  Description of Artificial Sequence: Synthetic oligonucleotide
tgtcaggaggagcagagcct

SEQ ID NO: 5936 - DNA, 20 bp, Artificial Sequence
  Description of Artificial Sequence: Synthetic oligonucleotide
gtcaggaggagcagagcctt

SEQ ID NO: 5937 - DNA, 20 bp, Artificial Sequence
  Description of Artificial Sequence: Synthetic oligonucleotide
tcaggaggagcagagcctta

SEQ ID NO: 5938 - DNA, 20 bp, Artificial Sequence
  Description of Artificial Sequence: Synthetic oligonucleotide
caggaggagcagagccttaa

SEQ ID NO: 5939 - DNA, 20 bp, Artificial Sequence
  Description of Artificial Sequence: Synthetic oligonucleotide
aggaggagcagagccttaaa

SEQ ID NO: 5940 - DNA, 20 bp, Artificial Sequence
  Description of Artificial Sequence: Synthetic oligonucleotide
ggaggagcagagccttaaag

SEQ ID NO: 5941 - DNA, 20 bp, Artificial Sequence
  Description of Artificial Sequence: Synthetic oligonucleotide
gaggagcagagccttaaaga

SEQ ID NO: 5942 - DNA, 20 bp, Artificial Sequence
  Description of Artificial Sequence: Synthetic oligonucleotide
aggagcagagccttaaagaa

SEQ ID NO: 5943 - DNA, 20 bp, Artificial Sequence
  Description of Artificial Sequence: Synthetic oligonucleotide
ggagcagagccttaaagaaa

SEQ ID NO: 5944 - DNA, 20 bp, Artificial Sequence
  Description of Artificial Sequence: Synthetic oligonucleotide
gagcagagccttaaagaaag

SEQ ID NO: 5945 - DNA, 20 bp, Artificial Sequence
  Description of Artificial Sequence: Synthetic oligonucleotide
agcagagccttaaagaaagt

SEQ ID NO: 5946 - DNA, 20 bp, Artificial Sequence
  Description of Artificial Sequence: Synthetic oligonucleotide
gcagagccttaaagaaagtg

SEQ ID NO: 5947 - DNA, 20 bp, Artificial Sequence
  Description of Artificial Sequence: Synthetic oligonucleotide
cagagccttaaagaaagtgc

SEQ ID NO: 5948 - DNA, 20 bp, Artificial Sequence
  Description of Artificial Sequence: Synthetic oligonucleotide
agagccttaaagaaagtgca

SEQ ID NO: 5949 - DNA, 20 bp, Artificial Sequence
  Description of Artificial Sequence: Synthetic oligonucleotide
gagccttaaagaaagtgcag

SEQ ID NO: 5950 - DNA, 20 bp, Artificial Sequence
  Description of Artificial Sequence: Synthetic oligonucleotide
agccttaaagaaagtgcagc

SEQ ID NO: 5951 - DNA, 20 bp, Artificial Sequence
  Description of Artificial Sequence: Synthetic oligonucleotide
gccttaaagaaagtgcagca

SEQ ID NO: 5952 - DNA, 20 bp, Artificial Sequence
  Description of Artificial Sequence: Synthetic oligonucleotide
ccttaaagaaagtgcagcag

SEQ ID NO: 5953 - DNA, 20 bp, Artificial Sequence
  Description of Artificial Sequence: Synthetic oligonucleotide
cttaaagaaagtgcagcagg

SEQ ID NO: 5954 - DNA, 20 bp, Artificial Sequence
  Description of Artificial Sequence: Synthetic oligonucleotide
ttaaagaaagtgcagcaggc

SEQ ID NO: 5955 - DNA, 20 bp, Artificial Sequence
  Description of Artificial Sequence: Synthetic oligonucleotide
taaagaaagtgcagcaggct

SEQ ID NO: 5956 - DNA, 20 bp, Artificial Sequence
  Description of Artificial Sequence: Synthetic oligonucleotide
aaagaaagtgcagcaggctc

SEQ ID NO: 5957 - DNA, 20 bp, Artificial Sequence
  Description of Artificial Sequence: Synthetic oligonucleotide
aagaaagtgcagcaggctcc

SEQ ID NO: 5958 - DNA, 20 bp, Artificial Sequence
  Description of Artificial Sequence: Synthetic oligonucleotide
agaaagtgcagcaggctcca

SEQ ID NO: 5959 - DNA, 20 bp, Artificial Sequence
  Description of Artificial Sequence: Synthetic oligonucleotide
gaaagtgcagcaggctccat

SEQ ID NO: 5960 - DNA, 20 bp, Artificial Sequence
  Description of Artificial Sequence: Synthetic oligonucleotide
aaagtgcagcaggctccatt

SEQ ID NO: 5961 - DNA, 20 bp, Artificial Sequence
  Description of Artificial Sequence: Synthetic oligonucleotide
aagtgcagcaggctccattt

SEQ ID NO: 5962 - DNA, 20 bp, Artificial Sequence
  Description of Artificial Sequence: Synthetic oligonucleotide
agtgcagcaggctccatttc

SEQ ID NO: 5963 - DNA, 20 bp, Artificial Sequence
  Description of Artificial Sequence: Synthetic oligonucleotide
gtgcagcaggctccatttca

SEQ ID NO: 5964 - DNA, 20 bp, Artificial Sequence
  Description of Artificial Sequence: Synthetic oligonucleotide
tgcagcaggctccatttcat

SEQ ID NO: 5965 - DNA, 20 bp, Artificial Sequence
  Description of Artificial Sequence: Synthetic oligonucleotide
gcagcaggctccatttcatg

SEQ ID NO: 5966 - DNA, 20 bp, Artificial Sequence
  Description of Artificial Sequence: Synthetic oligonucleotide
cagcaggctccatttcatgc

SEQ ID NO: 5967 - DNA, 20 bp, Artificial Sequence
  Description of Artificial Sequence: Synthetic oligonucleotide
agcaggctccatttcatgct

SEQ ID NO: 5968 - DNA, 20 bp, Artificial Sequence
  Description of Artificial Sequence: Synthetic oligonucleotide
gcaggctccatttcatgctg

SEQ ID NO: 5969 - DNA, 20 bp, Artificial Sequence
  Description of Artificial Sequence: Synthetic oligonucleotide
caggctccatttcatgctgt

SEQ ID NO: 5970 - DNA, 20 bp, Artificial Sequence
  Description of Artificial Sequence: Synthetic oligonucleotide
aggctccatttcatgctgtc

SEQ ID NO: 5971 - DNA, 20 bp, Artificial Sequence
  Description of Artificial Sequence: Synthetic oligonucleotide
ggctccatttcatgctgtct

SEQ ID NO: 5972 - DNA, 20 bp, Artificial Sequence
  Description of Artificial Sequence: Synthetic oligonucleotide
gctccatttcatgctgtctc

SEQ ID NO: 5973 - DNA, 20 bp, Artificial Sequence
  Description of Artificial Sequence: Synthetic oligonucleotide
ctccatttcatgctgtctct

SEQ ID NO: 5974 - DNA, 20 bp, Artificial Sequence
  Description of Artificial Sequence: Synthetic oligonucleotide
tccatttcatgctgtctcta

SEQ ID NO: 5975 - DNA, 20 bp, Artificial Sequence
  Description of Artificial Sequence: Synthetic oligonucleotide
ccatttcatgctgtctctat

SEQ ID NO: 5976 - DNA, 20 bp, Artificial Sequence
  Description of Artificial Sequence: Synthetic oligonucleotide
catttcatgctgtctctata

SEQ ID NO: 5977 - DNA, 20 bp, Artificial Sequence
  Description of Artificial Sequence: Synthetic oligonucleotide
atttcatgctgtctctatac

SEQ ID NO: 5978 - DNA, 20 bp, Artificial Sequence
  Description of Artificial Sequence: Synthetic oligonucleotide
tttcatgctgtctctatacc

SEQ ID NO: 5979 - DNA, 20 bp, Artificial Sequence
  Description of Artificial Sequence: Synthetic oligonucleotide
ttcatgctgtctctataccc

SEQ ID NO: 5980 - DNA, 20 bp, Artificial Sequence
  Description of Artificial Sequence: Synthetic oligonucleotide
tcatgctgtctctatacccc

SEQ ID NO: 5981 - DNA, 20 bp, Artificial Sequence
  Description of Artificial Sequence: Synthetic oligonucleotide
catgctgtctctatacccct

SEQ ID NO: 5982 - DNA, 20 bp, Artificial Sequence
  Description of Artificial Sequence: Synthetic oligonucleotide
atgctgtctctatacccctt

SEQ ID NO: 5983 - DNA, 20 bp, Artificial Sequence
  Description of Artificial Sequence: Synthetic oligonucleotide
tgctgtctctataccccttc

SEQ ID NO: 5984 - DNA, 20 bp, Artificial Sequence
  Description of Artificial Sequence: Synthetic oligonucleotide
gctgtctctataccccttct

SEQ ID NO: 5985 - DNA, 20 bp, Artificial Sequence
  Description of Artificial Sequence: Synthetic oligonucleotide
ctgtctctataccccttctc

SEQ ID NO: 5986 - DNA, 20 bp, Artificial Sequence
  Description of Artificial Sequence: Synthetic oligonucleotide
tgtctctataccccttctct

SEQ ID NO: 5987 - DNA, 20 bp, Artificial Sequence
  Description of Artificial Sequence: Synthetic oligonucleotide
gtctctataccccttctctc

SEQ ID NO: 5988 - DNA, 20 bp, Artificial Sequence
  Description of Artificial Sequence: Synthetic oligonucleotide
tctctataccccttctctcc

SEQ ID NO: 5989 - DNA, 20 bp, Artificial Sequence
  Description of Artificial Sequence: Synthetic oligonucleotide
ctctataccccttctctcct

SEQ ID NO: 5990 - DNA, 20 bp, Artificial Sequence
  Description of Artificial Sequence: Synthetic oligonucleotide
tctataccccttctctcctg

SEQ ID NO: 5991 - DNA, 20 bp, Artificial Sequence
  Description of Artificial Sequence: Synthetic oligonucleotide
ctataccccttctctcctga

SEQ ID NO: 5992 - DNA, 20 bp, Artificial Sequence
  Description of Artificial Sequence: Synthetic oligonucleotide
tataccccttctctcctgac

SEQ ID NO: 5993 - DNA, 20 bp, Artificial Sequence
  Description of Artificial Sequence: Synthetic oligonucleotide
ataccccttctctcctgaca

SEQ ID NO: 5994 - DNA, 20 bp, Artificial Sequence
  Description of Artificial Sequence: Synthetic oligonucleotide
taccccttctctcctgacag

SEQ ID NO: 5995 - DNA, 20 bp, Artificial Sequence
  Description of Artificial Sequence: Synthetic oligonucleotide
accccttctctcctgacagt

SEQ ID NO: 5996 - DNA, 20 bp, Artificial Sequence
  Description of Artificial Sequence: Synthetic oligonucleotide
ccccttctctcctgacagtc

SEQ ID NO: 5997 - DNA, 20 bp, Artificial Sequence
  Description of Artificial Sequence: Synthetic oligonucleotide
cccttctctcctgacagtcc

SEQ ID NO: 5998 - DNA, 20 bp, Artificial Sequence
  Description of Artificial Sequence: Synthetic oligonucleotide
ccttctctcctgacagtccc

SEQ ID NO: 5999 - DNA, 20 bp, Artificial Sequence
  Description of Artificial Sequence: Synthetic oligonucleotide
cttctctcctgacagtccca

SEQ ID NO: 6000 - DNA, 20 bp, Artificial Sequence
  Description of Artificial Sequence: Synthetic oligonucleotide
ttctctcctgacagtcccat

SEQ ID NO: 6001 - DNA, 20 bp, Artificial Sequence
  Description of Artificial Sequence: Synthetic oligonucleotide
tctctcctgacagtcccata

SEQ ID NO: 6002 - DNA, 20 bp, Artificial Sequence
  Description of Artificial Sequence: Synthetic oligonucleotide
ctctcctgacagtcccatag

SEQ ID NO: 6003 - DNA, 20 bp, Artificial Sequence
  Description of Artificial Sequence: Synthetic oligonucleotide
tctcctgacagtcccatagc

SEQ ID NO: 6004 - DNA, 20 bp, Artificial Sequence
  Description of Artificial Sequence: Synthetic oligonucleotide
ctcctgacagtcccatagcc

SEQ ID NO: 6005 - DNA, 20 bp, Artificial Sequence
  Description of Artificial Sequence: Synthetic oligonucleotide
tcctgacagtcccatagcca

SEQ ID NO: 6006 - DNA, 20 bp, Artificial Sequence
  Description of Artificial Sequence: Synthetic oligonucleotide
cctgacagtcccatagccaa

SEQ ID NO: 6007 - DNA, 20 bp, Artificial Sequence
  Description of Artificial Sequence: Synthetic oligonucleotide
ctgacagtcccatagccaaa

SEQ ID NO: 6008 - DNA, 20 bp, Artificial Sequence
  Description of Artificial Sequence: Synthetic oligonucleotide
tgacagtcccatagccaaac

SEQ ID NO: 6009 - DNA, 20 bp, Artificial Sequence
  Description of Artificial Sequence: Synthetic oligonucleotide
gacagtcccatagccaaaca

SEQ ID NO: 6010 - DNA, 20 bp, Artificial Sequence
  Description of Artificial Sequence: Synthetic oligonucleotide
acagtcccatagccaaacat

SEQ ID NO: 6011 - DNA, 20 bp, Artificial Sequence
  Description of Artificial Sequence: Synthetic oligonucleotide
cagtcccatagccaaacatc

SEQ ID NO: 6012 - DNA, 20 bp, Artificial Sequence
  Description of Artificial Sequence: Synthetic oligonucleotide
agtcccatagccaaacatct

SEQ ID NO: 6013 - DNA, 20 bp, Artificial Sequence
  Description of Artificial Sequence: Synthetic oligonucleotide
gtcccatagccaaacatctt

SEQ ID NO: 6014 - DNA, 20 bp, Artificial Sequence
  Description of Artificial Sequence: Synthetic oligonucleotide
tcccatagccaaacatcttt

SEQ ID NO: 6015 - DNA, 20 bp, Artificial Sequence
  Description of Artificial Sequence: Synthetic oligonucleotide
cccatagccaaacatctttt

SEQ ID NO: 6016 - DNA, 20 bp, Artificial Sequence
  Description of Artificial Sequence: Synthetic oligonucleotide
ccatagccaaacatcttttt

SEQ ID NO: 6017 - DNA, 20 bp, Artificial Sequence
  Description of Artificial Sequence: Synthetic oligonucleotide
catagccaaacatcttttta

SEQ ID NO: 6018 - DNA, 20 bp, Artificial Sequence
  Description of Artificial Sequence: Synthetic oligonucleotide
atagccaaacatctttttat

SEQ ID NO: 6019 - DNA, 20 bp, Artificial Sequence
  Description of Artificial Sequence: Synthetic oligonucleotide
tagccaaacatctttttata

SEQ ID NO: 6020 - DNA, 20 bp, Artificial Sequence
  Description of Artificial Sequence: Synthetic oligonucleotide
agccaaacatctttttatag

SEQ ID NO: 6021 - DNA, 20 bp, Artificial Sequence
  Description of Artificial Sequence: Synthetic oligonucleotide
gccaaacatctttttatagg

SEQ ID NO: 6022 - DNA, 20 bp, Artificial Sequence
  Description of Artificial Sequence: Synthetic oligonucleotide
ccaaacatctttttataggt

SEQ ID NO: 6023 - DNA, 20 bp, Artificial Sequence
  Description of Artificial Sequence: Synthetic oligonucleotide
caaacatctttttataggtg

SEQ ID NO: 6024 - DNA, 20 bp, Artificial Sequence
  Description of Artificial Sequence: Synthetic oligonucleotide
aaacatctttttataggtgt

SEQ ID NO: 6025 - DNA, 20 bp, Artificial Sequence
  Description of Artificial Sequence: Synthetic oligonucleotide
aacatctttttataggtgtg

SEQ ID NO: 6026 - DNA, 20 bp, Artificial Sequence
  Description of Artificial Sequence: Synthetic oligonucleotide
acatctttttataggtgtga

SEQ ID NO: 6027 - DNA, 20 bp, Artificial Sequence
  Description of Artificial Sequence: Synthetic oligonucleotide
catctttttataggtgtgaa

SEQ ID NO: 6028 - DNA, 20 bp, Artificial Sequence
  Description of Artificial Sequence: Synthetic oligonucleotide
atctttttataggtgtgaat

SEQ ID NO: 6029 - DNA, 20 bp, Artificial Sequence
  Description of Artificial Sequence: Synthetic oligonucleotide
tctttttataggtgtgaatc

SEQ ID NO: 6030 - DNA, 20 bp, Artificial Sequence
  Description of Artificial Sequence: Synthetic oligonucleotide
ctttttataggtgtgaatct

SEQ ID NO: 6031 - DNA, 20 bp, Artificial Sequence
  Description of Artificial Sequence: Synthetic oligonucleotide
tttttataggtgtgaatcta

SEQ ID NO: 6032 - DNA, 20 bp, Artificial Sequence
  Description of Artificial Sequence: Synthetic oligonucleotide
ttttataggtgtgaatctaa

SEQ ID NO: 6033 - DNA, 20 bp, Artificial Sequence
  Description of Artificial Sequence: Synthetic oligonucleotide
tttataggtgtgaatctaat

SEQ ID NO: 6034 - DNA, 20 bp, Artificial Sequence
  Description of Artificial Sequence: Synthetic oligonucleotide
ttataggtgtgaatctaata

SEQ ID NO: 6035 - DNA, 20 bp, Artificial Sequence
  Description of Artificial Sequence: Synthetic oligonucleotide
tataggtgtgaatctaataa

SEQ ID NO: 6036 - DNA, 20 bp, Artificial Sequence
  Description of Artificial Sequence: Synthetic oligonucleotide
ataggtgtgaatctaataag

SEQ ID NO: 6037 - DNA, 20 bp, Artificial Sequence
  Description of Artificial Sequence: Synthetic oligonucleotide
taggtgtgaatctaataaga

SEQ ID NO: 6038 - DNA, 20 bp, Artificial Sequence
  Description of Artificial Sequence: Synthetic oligonucleotide
aggtgtgaatctaataagac

SEQ ID NO: 6039 - DNA, 20 bp, Artificial Sequence
  Description of Artificial Sequence: Synthetic oligonucleotide
ggtgtgaatctaataagact

SEQ ID NO: 6040 - DNA, 20 bp, Artificial Sequence
  Description of Artificial Sequence: Synthetic oligonucleotide
gtgtgaatctaataagactt

SEQ ID NO: 6041 - DNA, 20 bp, Artificial Sequence
  Description of Artificial Sequence: Synthetic oligonucleotide
tgtgaatctaataagacttt

SEQ ID NO: 6042 - DNA, 20 bp, Artificial Sequence
  Description of Artificial Sequence: Synthetic oligonucleotide
gtgaatctaataagacttta

SEQ ID NO: 6043 - DNA, 20 bp, Artificial Sequence
  Description of Artificial Sequence: Synthetic oligonucleotide
tgaatctaataagactttat

SEQ ID NO: 6044 - DNA, 20 bp, Artificial Sequence
  Description of Artificial Sequence: Synthetic oligonucleotide
gaatctaataagactttatt

SEQ ID NO: 6045 - DNA, 20 bp, Artificial Sequence
  Description of Artificial Sequence: Synthetic oligonucleotide
aatctaataagactttatta

SEQ ID NO: 6046 - DNA, 20 bp, Artificial Sequence
  Description of Artificial Sequence: Synthetic oligonucleotide
atctaataagactttattac

SEQ ID NO: 6047 - DNA, 20 bp, Artificial Sequence
  Description of Artificial Sequence: Synthetic oligonucleotide
tctaataagactttattact

SEQ ID NO: 6048 - DNA, 20 bp, Artificial Sequence
  Description of Artificial Sequence: Synthetic oligonucleotide
ctaataagactttattactt

SEQ ID NO: 6049 - DNA, 20 bp, Artificial Sequence
  Description of Artificial Sequence: Synthetic oligonucleotide
taataagactttattacttg

SEQ ID NO: 6050 - DNA, 20 bp, Artificial Sequence
  Description of Artificial Sequence: Synthetic oligonucleotide
aataagactttattacttgt

SEQ ID NO: 6051 - DNA, 20 bp, Artificial Sequence
  Description of Artificial Sequence: Synthetic oligonucleotide
ataagactttattacttgtt

SEQ ID NO: 6052 - DNA, 20 bp, Artificial Sequence
  Description of Artificial Sequence: Synthetic oligonucleotide
taagactttattacttgttt

SEQ ID NO: 6053 - DNA, 20 bp, Artificial Sequence
  Description of Artificial Sequence: Synthetic oligonucleotide
aagactttattacttgttta

SEQ ID NO: 6054 - DNA, 20 bp, Artificial Sequence
  Description of Artificial Sequence: Synthetic oligonucleotide
agactttattacttgtttac

SEQ ID NO: 6055 - DNA, 20 bp, Artificial Sequence
  Description of Artificial Sequence: Synthetic oligonucleotide
gactttattacttgtttacc

SEQ ID NO: 6056 - DNA, 20 bp, Artificial Sequence
  Description of Artificial Sequence: Synthetic oligonucleotide
actttattacttgtttacct

SEQ ID NO: 6057 - DNA, 20 bp, Artificial Sequence
  Description of Artificial Sequence: Synthetic oligonucleotide
ctttattacttgtttacctc

SEQ ID NO: 6058 - DNA, 20 bp, Artificial Sequence
  Description of Artificial Sequence: Synthetic oligonucleotide
tttattacttgtttacctcc

SEQ ID NO: 6059 - DNA, 20 bp, Artificial Sequence
  Description of Artificial Sequence: Synthetic oligonucleotide
ttattacttgtttacctcca

SEQ ID NO: 6060 - DNA, 20 bp, Artificial Sequence
  Description of Artificial Sequence: Synthetic oligonucleotide
tattacttgtttacctccag

SEQ ID NO: 6061 - DNA, 20 bp, Artificial Sequence
  Description of Artificial Sequence: Synthetic oligonucleotide
attacttgtttacctccagt

SEQ ID NO: 6062 - DNA, 20 bp, Artificial Sequence
  Description of Artificial Sequence: Synthetic oligonucleotide
ttacttgtttacctccagtt

SEQ ID NO: 6063 - DNA, 20 bp, Artificial Sequence
  Description of Artificial Sequence: Synthetic oligonucleotide
tacttgtttacctccagttt

SEQ ID NO: 6064 - DNA, 20 bp, Artificial Sequence
  Description of Artificial Sequence: Synthetic oligonucleotide
acttgtttacctccagttta

SEQ ID NO: 6065 - DNA, 20 bp, Artificial Sequence
  Description of Artificial Sequence: Synthetic oligonucleotide
cttgtttacctccagtttac

SEQ ID NO: 6066 - DNA, 20 bp, Artificial Sequence
  Description of Artificial Sequence: Synthetic oligonucleotide
ttgtttacctccagtttact

SEQ ID NO: 6067 - DNA, 20 bp, Artificial Sequence
  Description of Artificial Sequence: Synthetic oligonucleotide
tgtttacctccagtttactg

SEQ ID NO: 6068 - DNA, 20 bp, Artificial Sequence
  Description of Artificial Sequence: Synthetic oligonucleotide
gtttacctccagtttactgt

SEQ ID NO: 6069 - DNA, 20 bp, Artificial Sequence
  Description of Artificial Sequence: Synthetic oligonucleotide
tttacctccagtttactgtg

SEQ ID NO: 6070 - DNA, 20 bp, Artificial Sequence
  Description of Artificial Sequence: Synthetic oligonucleotide
ttacctccagtttactgtgt

SEQ ID NO: 6071 - DNA, 20 bp, Artificial Sequence
  Description of Artificial Sequence: Synthetic oligonucleotide
tacctccagtttactgtgtt

SEQ ID NO: 6072 - DNA, 20 bp, Artificial Sequence
  Description of Artificial Sequence: Synthetic oligonucleotide
acctccagtttactgtgtta

SEQ ID NO: 6073 - DNA, 20 bp, Artificial Sequence
  Description of Artificial Sequence: Synthetic oligonucleotide
cctccagtttactgtgttaa

SEQ ID NO: 6074 - DNA, 20 bp, Artificial Sequence
  Description of Artificial Sequence: Synthetic oligonucleotide
ctccagtttactgtgttaac

SEQ ID NO: 6075 - DNA, 20 bp, Artificial Sequence
  Description of Artificial Sequence: Synthetic oligonucleotide
tccagtttactgtgttaacc

SEQ ID NO: 6076 - DNA, 20 bp, Artificial Sequence
  Description of Artificial Sequence: Synthetic oligonucleotide
ccagtttactgtgttaacct

SEQ ID NO: 6077 - DNA, 20 bp, Artificial Sequence
  Description of Artificial Sequence: Synthetic oligonucleotide
cagtttactgtgttaacctg

SEQ ID NO: 6078 - DNA, 20 bp, Artificial Sequence
  Description of Artificial Sequence: Synthetic oligonucleotide
agtttactgtgttaacctgg

SEQ ID NO: 6079 - DNA, 20 bp, Artificial Sequence
  Description of Artificial Sequence: Synthetic oligonucleotide
gtttactgtgttaacctggg

SEQ ID NO: 6080 - DNA, 20 bp, Artificial Sequence
  Description of Artificial Sequence: Synthetic oligonucleotide
tttactgtgttaacctggga

SEQ ID NO: 6081 - DNA, 20 bp, Artificial Sequence
  Description of Artificial Sequence: Synthetic oligonucleotide
ttactgtgttaacctgggaa

SEQ ID NO: 6082 - DNA, 20 bp, Artificial Sequence
  Description of Artificial Sequence: Synthetic oligonucleotide
tactgtgttaacctgggaat

SEQ ID NO: 6083 - DNA, 20 bp, Artificial Sequence
  Description of Artificial Sequence: Synthetic oligonucleotide
actgtgttaacctgggaatc

SEQ ID NO: 6084 - DNA, 20 bp, Artificial Sequence
  Description of Artificial Sequence: Synthetic oligonucleotide
ctgtgttaacctgggaatca

SEQ ID NO: 6085 - DNA, 20 bp, Artificial Sequence
  Description of Artificial Sequence: Synthetic oligonucleotide
tgtgttaacctgggaatcag

SEQ ID NO: 6086 - DNA, 20 bp, Artificial Sequence
  Description of Artificial Sequence: Synthetic oligonucleotide
gtgttaacctgggaatcaga

SEQ ID NO: 6087 - DNA, 20 bp, Artificial Sequence
  Description of Artificial Sequence: Synthetic oligonucleotide
tgttaacctgggaatcagaa

SEQ ID NO: 6088 - DNA, 20 bp, Artificial Sequence
  Description of Artificial Sequence: Synthetic oligonucleotide
gttaacctgggaatcagaaa

SEQ ID NO: 6089 - DNA, 20 bp, Artificial Sequence
  Description of Artificial Sequence: Synthetic oligonucleotide
ttaacctgggaatcagaaaa

SEQ ID NO: 6090 - DNA, 20 bp, Artificial Sequence
  Description of Artificial Sequence: Synthetic oligonucleotide
taacctgggaatcagaaaac

SEQ ID NO: 6091 - DNA, 20 bp, Artificial Sequence
  Description of Artificial Sequence: Synthetic oligonucleotide
aacctgggaatcagaaaaca

SEQ ID NO: 6092 - DNA, 20 bp, Artificial Sequence
  Description of Artificial Sequence: Synthetic oligonucleotide
acctgggaatcagaaaacaa

SEQ ID NO: 6093 - DNA, 20 bp, Artificial Sequence
  Description of Artificial Sequence: Synthetic oligonucleotide
cctgggaatcagaaaacaag

SEQ ID NO: 6094 - DNA, 20 bp, Artificial Sequence
  Description of Artificial Sequence: Synthetic oligonucleotide
ctgggaatcagaaaacaagg

SEQ ID NO: 6095 - DNA, 20 bp, Artificial Sequence
  Description of Artificial Sequence: Synthetic oligonucleotide
tgggaatcagaaaacaaggc

SEQ ID NO: 6096 - DNA, 20 bp, Artificial Sequence
  Description of Artificial Sequence: Synthetic oligonucleotide
gggaatcagaaaacaaggct

SEQ ID NO: 6097 - DNA, 20 bp, Artificial Sequence
  Description of Artificial Sequence: Synthetic oligonucleotide
ggaatcagaaaacaaggctc

SEQ ID NO: 6098 - DNA, 20 bp, Artificial Sequence
  Description of Artificial Sequence: Synthetic oligonucleotide
gaatcagaaaacaaggctcg

SEQ ID NO: 6099 - DNA, 20 bp, Artificial Sequence
  Description of Artificial Sequence: Synthetic oligonucleotide
aatcagaaaacaaggctcga

SEQ ID NO: 6100 - DNA, 20 bp, Artificial Sequence
  Description of Artificial Sequence: Synthetic oligonucleotide
atcagaaaacaaggctcgaa

SEQ ID NO: 6101 - DNA, 20 bp, Artificial Sequence
  Description of Artificial Sequence: Synthetic oligonucleotide
tcagaaaacaaggctcgaac

SEQ ID NO: 6102 - DNA, 20 bp, Artificial Sequence
  Description of Artificial Sequence: Synthetic oligonucleotide
cagaaaacaaggctcgaact

SEQ ID NO: 6103 - DNA, 20 bp, Artificial Sequence
  Description of Artificial Sequence: Synthetic oligonucleotide
agaaaacaaggctcgaactt

SEQ ID NO: 6104 - DNA, 20 bp, Artificial Sequence
  Description of Artificial Sequence: Synthetic oligonucleotide
gaaaacaaggctcgaacttc

SEQ ID NO: 6105 - DNA, 20 bp, Artificial Sequence
  Description of Artificial Sequence: Synthetic oligonucleotide
aaaacaaggctcgaacttct

SEQ ID NO: 6106 - DNA, 20 bp, Artificial Sequence
  Description of Artificial Sequence: Synthetic oligonucleotide
aaacaaggctcgaacttctt

SEQ ID NO: 6107 - DNA, 20 bp, Artificial Sequence
  Description of Artificial Sequence: Synthetic oligonucleotide
aacaaggctcgaacttcttt

SEQ ID NO: 6108 - DNA, 20 bp, Artificial Sequence
  Description of Artificial Sequence: Synthetic oligonucleotide
acaaggctcgaacttctttc

SEQ ID NO: 6109 - DNA, 20 bp, Artificial Sequence
  Description of Artificial Sequence: Synthetic oligonucleotide
caaggctcgaacttctttcc

SEQ ID NO: 6110 - DNA, 20 bp, Artificial Sequence
  Description of Artificial Sequence: Synthetic oligonucleotide
aaggctcgaacttctttcct

SEQ ID NO: 6111 - DNA, 20 bp, Artificial Sequence
  Description of Artificial Sequence: Synthetic oligonucleotide
aggctcgaacttctttcctg

SEQ ID NO: 6112 - DNA, 20 bp, Artificial Sequence
  Description of Artificial Sequence: Synthetic oligonucleotide
ggctcgaacttctttcctga

SEQ ID NO: 6113 - DNA, 20 bp, Artificial Sequence
  Description of Artificial Sequence: Synthetic oligonucleotide
gctcgaacttctttcctgat

SEQ ID NO: 6114 - DNA, 20 bp, Artificial Sequence
  Description of Artificial Sequence: Synthetic oligonucleotide
ctcgaacttctttcctgatt

SEQ ID NO: 6115 - DNA, 20 bp, Artificial Sequence
  Description of Artificial Sequence: Synthetic oligonucleotide
tcgaacttctttcctgattc

SEQ ID NO: 6116 - DNA, 20 bp, Artificial Sequence
  Description of Artificial Sequence: Synthetic oligonucleotide
cgaacttctttcctgattca

SEQ ID NO: 6117 - DNA, 20 bp, Artificial Sequence
  Description of Artificial Sequence: Synthetic oligonucleotide
gaacttctttcctgattcac

SEQ ID NO: 6118 - DNA, 20 bp, Artificial Sequence
  Description of Artificial Sequence: Synthetic oligonucleotide
aacttctttcctgattcacc

SEQ ID NO: 6119 - DNA, 20 bp, Artificial Sequence
  Description of Artificial Sequence: Synthetic oligonucleotide
acttctttcctgattcacca

SEQ ID NO: 6120 - DNA, 20 bp, Artificial Sequence
  Description of Artificial Sequence: Synthetic oligonucleotide
cttctttcctgattcaccat

SEQ ID NO: 6121 - DNA, 20 bp, Artificial Sequence
  Description of Artificial Sequence: Synthetic oligonucleotide
ttctttcctgattcaccata

SEQ ID NO: 6122 - DNA, 20 bp, Artificial Sequence
  Description of Artificial Sequence: Synthetic oligonucleotide
tctttcctgattcaccatat

SEQ ID NO: 6123 - DNA, 20 bp, Artificial Sequence
  Description of Artificial Sequence: Synthetic oligonucleotide
ctttcctgattcaccatatg

SEQ ID NO: 6124 - DNA, 20 bp, Artificial Sequence
  Description of Artificial Sequence: Synthetic oligonucleotide
tttcctgattcaccatatgg

SEQ ID NO: 6125 - DNA, 20 bp, Artificial Sequence
  Description of Artificial Sequence: Synthetic oligonucleotide
ttcctgattcaccatatggc

SEQ ID NO: 6126 - DNA, 20 bp, Artificial Sequence
  Description of Artificial Sequence: Synthetic oligonucleotide
tcctgattcaccatatggcc

SEQ ID NO: 6127 - DNA, 20 bp, Artificial Sequence
  Description of Artificial Sequence: Synthetic oligonucleotide
cctgattcaccatatggcct

SEQ ID NO: 6128 - DNA, 20 bp, Artificial Sequence
  Description of Artificial Sequence: Synthetic oligonucleotide
ctgattcaccatatggcctt

SEQ ID NO: 6129 - DNA, 20 bp, Artificial Sequence
  Description of Artificial Sequence: Synthetic oligonucleotide
tgattcaccatatggccttg

SEQ ID NO: 6130 - DNA, 20 bp, Artificial Sequence
  Description of Artificial Sequence: Synthetic oligonucleotide
gattcaccatatggccttga

SEQ ID NO: 6131 - DNA, 20 bp, Artificial Sequence
  Description of Artificial Sequence: Synthetic oligonucleotide
attcaccatatggccttgat

SEQ ID NO: 6132 - DNA, 20 bp, Artificial Sequence
  Description of Artificial Sequence: Synthetic oligonucleotide
ttcaccatatggccttgatt

SEQ ID NO: 6133 - DNA, 20 bp, Artificial Sequence
  Description of Artificial Sequence: Synthetic oligonucleotide
tcaccatatggccttgatta

SEQ ID NO: 6134 - DNA, 20 bp, Artificial Sequence
  Description of Artificial Sequence: Synthetic oligonucleotide
caccatatggccttgattag

SEQ ID NO: 6135 - DNA, 20 bp, Artificial Sequence
  Description of Artificial Sequence: Synthetic oligonucleotide
accatatggccttgattagt

SEQ ID NO: 6136 - DNA, 20 bp, Artificial Sequence
  Description of Artificial Sequence: Synthetic oligonucleotide
ccatatggccttgattagtc

SEQ ID NO: 6137 - DNA, 20 bp, Artificial Sequence
  Description of Artificial Sequence: Synthetic oligonucleotide
catatggccttgattagtct

SEQ ID NO: 6138 - DNA, 20 bp, Artificial Sequence
  Description of Artificial Sequence: Synthetic oligonucleotide
atatggccttgattagtctc

SEQ ID NO: 6139 - DNA, 20 bp, Artificial Sequence
  Description of Artificial Sequence: Synthetic oligonucleotide
tatggccttgattagtctct

SEQ ID NO: 6140 - DNA, 20 bp, Artificial Sequence
  Description of Artificial Sequence: Synthetic oligonucleotide
atggccttgattagtctctc

SEQ ID NO: 6141 - DNA, 20 bp, Artificial Sequence
  Description of Artificial Sequence: Synthetic oligonucleotide
tggccttgattagtctctct

SEQ ID NO: 6142 - DNA, 20 bp, Artificial Sequence
  Description of Artificial Sequence: Synthetic oligonucleotide
ggccttgattagtctctctt

SEQ ID NO: 6143 - DNA, 20 bp, Artificial Sequence
  Description of Artificial Sequence: Synthetic oligonucleotide
gccttgattagtctctcttt

SEQ ID NO: 6144 - DNA, 20 bp, Artificial Sequence
  Description of Artificial Sequence: Synthetic oligonucleotide
ccttgattagtctctctttc

SEQ ID NO: 6145 - DNA, 20 bp, Artificial Sequence
  Description of Artificial Sequence: Synthetic oligonucleotide
cttgattagtctctctttct

SEQ ID NO: 6146 - DNA, 20 bp, Artificial Sequence
  Description of Artificial Sequence: Synthetic oligonucleotide
ttgattagtctctctttcta

SEQ ID NO: 6147 - DNA, 20 bp, Artificial Sequence
  Description of Artificial Sequence: Synthetic oligonucleotide
tgattagtctctctttctat

SEQ ID NO: 6148 - DNA, 20 bp, Artificial Sequence
  Description of Artificial Sequence: Synthetic oligonucleotide
gattagtctctctttctata

SEQ ID NO: 6149 - DNA, 20 bp, Artificial Sequence
  Description of Artificial Sequence: Synthetic oligonucleotide
attagtctctctttctatat

SEQ ID NO: 6150 - DNA, 20 bp, Artificial Sequence
  Description of Artificial Sequence: Synthetic oligonucleotide
ttagtctctctttctatatt

SEQ ID NO: 6151 - DNA, 20 bp, Artificial Sequence
  Description of Artificial Sequence: Synthetic oligonucleotide
tagtctctctttctatattc

SEQ ID NO: 6152 - DNA, 20 bp, Artificial Sequence
  Description of Artificial Sequence: Synthetic oligonucleotide
agtctctctttctatattcc

SEQ ID NO: 6153 - DNA, 20 bp, Artificial Sequence
  Description of Artificial Sequence: Synthetic oligonucleotide
gtctctctttctatattcct

SEQ ID NO: 6154 - DNA, 20 bp, Artificial Sequence
  Description of Artificial Sequence: Synthetic oligonucleotide
tctctctttctatattcctc

SEQ ID NO: 6155 - DNA, 20 bp, Artificial Sequence
  Description of Artificial Sequence: Synthetic oligonucleotide
ctctctttctatattcctca

SEQ ID NO: 6156 - DNA, 20 bp, Artificial Sequence
  Description of Artificial Sequence: Synthetic oligonucleotide
tctctttctatattcctcac

SEQ ID NO: 6157 - DNA, 20 bp, Artificial Sequence
  Description of Artificial Sequence: Synthetic oligonucleotide
ctctttctatattcctcact

SEQ ID NO: 6158 - DNA, 20 bp, Artificial Sequence
  Description of Artificial Sequence: Synthetic oligonucleotide
tctttctatattcctcactt

SEQ ID NO: 6159 - DNA, 20 bp, Artificial Sequence
  Description of Artificial Sequence: Synthetic oligonucleotide
ctttctatattcctcacttt

SEQ ID NO: 6160 - DNA, 20 bp, Artificial Sequence
  Description of Artificial Sequence: Synthetic oligonucleotide
tttctatattcctcactttc

SEQ ID NO: 6161 - DNA, 20 bp, Artificial Sequence
  Description of Artificial Sequence: Synthetic oligonucleotide
ttctatattcctcactttcc

SEQ ID NO: 6162 - DNA, 20 bp, Artificial Sequence
  Description of Artificial Sequence: Synthetic oligonucleotide
tctatattcctcactttcct

SEQ ID NO: 6163 - DNA, 20 bp, Artificial Sequence
  Description of Artificial Sequence: Synthetic oligonucleotide
ctatattcctcactttcctg

SEQ ID NO: 6164 - DNA, 20 bp, Artificial Sequence
  Description of Artificial Sequence: Synthetic oligonucleotide
tatattcctcactttcctgc

SEQ ID NO: 6165 - DNA, 20 bp, Artificial Sequence
  Description of Artificial Sequence: Synthetic oligonucleotide
atattcctcactttcctgct

SEQ ID NO: 6166 - DNA, 20 bp, Artificial Sequence
  Description of Artificial Sequence: Synthetic oligonucleotide
tattcctcactttcctgctt

SEQ ID NO: 6167 - DNA, 20 bp, Artificial Sequence
  Description of Artificial Sequence: Synthetic oligonucleotide
attcctcactttcctgctta

SEQ ID NO: 6168 - DNA, 20 bp, Artificial Sequence
  Description of Artificial Sequence: Synthetic oligonucleotide
ttcctcactttcctgcttat

SEQ ID NO: 6169 - DNA, 20 bp, Artificial Sequence
  Description of Artificial Sequence: Synthetic oligonucleotide
tcctcactttcctgcttata

SEQ ID NO: 6170 - DNA, 20 bp, Artificial Sequence
  Description of Artificial Sequence: Synthetic oligonucleotide
cctcactttcctgcttataa

SEQ ID NO: 6171 - DNA, 20 bp, Artificial Sequence
  Description of Artificial Sequence: Synthetic oligonucleotide
ctcactttcctgcttataag

SEQ ID NO: 6172 - DNA, 20 bp, Artificial Sequence
  Description of Artificial Sequence: Synthetic oligonucleotide
tcactttcctgcttataagg

SEQ ID NO: 6173 - DNA, 20 bp, Artificial Sequence
  Description of Artificial Sequence: Synthetic oligonucleotide
cactttcctgcttataaggt

SEQ ID NO: 6174 - DNA, 20 bp, Artificial Sequence
  Description of Artificial Sequence: Synthetic oligonucleotide
actttcctgcttataaggtg

SEQ ID NO: 6175 - DNA, 20 bp, Artificial Sequence
  Description of Artificial Sequence: Synthetic oligonucleotide
ctttcctgcttataaggtgc

SEQ ID NO: 6176 - DNA, 20 bp, Artificial Sequence
  Description of Artificial Sequence: Synthetic oligonucleotide
tttcctgcttataaggtgca

SEQ ID NO: 6177 - DNA, 20 bp, Artificial Sequence
  Description of Artificial Sequence: Synthetic oligonucleotide
ttcctgcttataaggtgcag

SEQ ID NO: 6178 - DNA, 20 bp, Artificial Sequence
  Description of Artificial Sequence: Synthetic oligonucleotide
tcctgcttataaggtgcagc

SEQ ID NO: 6179 - DNA, 20 bp, Artificial Sequence
  Description of Artificial Sequence: Synthetic oligonucleotide
cctgcttataaggtgcagct

SEQ ID NO: 6180 - DNA, 20 bp, Artificial Sequence
  Description of Artificial Sequence: Synthetic oligonucleotide
ctgcttataaggtgcagcta

SEQ ID NO: 6181 - DNA, 20 bp, Artificial Sequence
  Description of Artificial Sequence: Synthetic oligonucleotide
tgcttataaggtgcagctat

SEQ ID NO: 6182 - DNA, 20 bp, Artificial Sequence
  Description of Artificial Sequence: Synthetic oligonucleotide
gcttataaggtgcagctatg

SEQ ID NO: 6183 - DNA, 20 bp, Artificial Sequence
  Description of Artificial Sequence: Synthetic oligonucleotide
cttataaggtgcagctatgt

SEQ ID NO: 6184 - DNA, 20 bp, Artificial Sequence
  Description of Artificial Sequence: Synthetic oligonucleotide
ttataaggtgcagctatgtt

SEQ ID NO: 6185 - DNA, 20 bp, Artificial Sequence
  Description of Artificial Sequence: Synthetic oligonucleotide
tataaggtgcagctatgttt

SEQ ID NO: 6186 - DNA, 20 bp, Artificial Sequence
  Description of Artificial Sequence: Synthetic oligonucleotide
ataaggtgcagctatgtttt

SEQ ID NO: 6187 - DNA, 20 bp, Artificial Sequence
  Description of Artificial Sequence: Synthetic oligonucleotide
taaggtgcagctatgttttt

SEQ ID NO: 6188 - DNA, 20 bp, Artificial Sequence
  Description of Artificial Sequence: Synthetic oligonucleotide
aaggtgcagctatgtttttg

SEQ ID NO: 6189 - DNA, 20 bp, Artificial Sequence
  Description of Artificial Sequence: Synthetic oligonucleotide
aggtgcagctatgtttttgc

SEQ ID NO: 6190 - DNA, 20 bp, Artificial Sequence
  Description of Artificial Sequence: Synthetic oligonucleotide
ggtgcagctatgtttttgct

SEQ ID NO: 6191 - DNA, 20 bp, Artificial Sequence
  Description of Artificial Sequence: Synthetic oligonucleotide
gtgcagctatgtttttgctg

SEQ ID NO: 6192 - DNA, 20 bp, Artificial Sequence
  Description of Artificial Sequence: Synthetic oligonucleotide
tgcagctatgtttttgctga

SEQ ID NO: 6193 - DNA, 20 bp, Artificial Sequence
  Description of Artificial Sequence: Synthetic oligonucleotide
gcagctatgtttttgctgaa

SEQ ID NO: 6194 - DNA, 20 bp, Artificial Sequence
  Description of Artificial Sequence: Synthetic oligonucleotide
cagctatgtttttgctgaat

SEQ ID NO: 6195 - DNA, 20 bp, Artificial Sequence
  Description of Artificial Sequence: Synthetic oligonucleotide
agctatgtttttgctgaatc

SEQ ID NO: 6196 - DNA, 20 bp, Artificial Sequence
  Description of Artificial Sequence: Synthetic oligonucleotide
gctatgtttttgctgaatcc

SEQ ID NO: 6197 - DNA, 20 bp, Artificial Sequence
  Description of Artificial Sequence: Synthetic oligonucleotide
ctatgtttttgctgaatccc

SEQ ID NO: 6198 - DNA, 20 bp, Artificial Sequence
  Description of Artificial Sequence: Synthetic oligonucleotide
tatgtttttgctgaatccca

SEQ ID NO: 6199 - DNA, 20 bp, Artificial Sequence
  Description of Artificial Sequence: Synthetic oligonucleotide
atgtttttgctgaatcccac

SEQ ID NO: 6200 - DNA, 20 bp, Artificial Sequence
  Description of Artificial Sequence: Synthetic oligonucleotide
tgtttttgctgaatcccaca

SEQ ID NO: 6201 - DNA, 20 bp, Artificial Sequence
  Description of Artificial Sequence: Synthetic oligonucleotide
gtttttgctgaatcccacac

SEQ ID NO: 6202 - DNA, 20 bp, Artificial Sequence
  Description of Artificial Sequence: Synthetic oligonucleotide
tttttgctgaatcccacaca

SEQ ID NO: 6203 - DNA, 20 bp, Artificial Sequence
  Description of Artificial Sequence: Synthetic oligonucleotide
ttttgctgaatcccacacag

SEQ ID NO: 6204 - DNA, 20 bp, Artificial Sequence
  Description of Artificial Sequence: Synthetic oligonucleotide
tttgctgaatcccacacaga

SEQ ID NO: 6205 - DNA, 20 bp, Artificial Sequence
  Description of Artificial Sequence: Synthetic oligonucleotide
ttgctgaatcccacacagag

SEQ ID NO: 6206 - DNA, 20 bp, Artificial Sequence
  Description of Artificial Sequence: Synthetic oligonucleotide
tgctgaatcccacacagagc

SEQ ID NO: 6207 - DNA, 20 bp, Artificial Sequence
  Description of Artificial Sequence: Synthetic oligonucleotide
gctgaatcccacacagagct

SEQ ID NO: 6208 - DNA, 20 bp, Artificial Sequence
  Description of Artificial Sequence: Synthetic oligonucleotide
ctgaatcccacacagagctg

SEQ ID NO: 6209 - DNA, 20 bp, Artificial Sequence
  Description of Artificial Sequence: Synthetic oligonucleotide
tgaatcccacacagagctgc

SEQ ID NO: 6210 - DNA, 20 bp, Artificial Sequence
  Description of Artificial Sequence: Synthetic oligonucleotide
gaatcccacacagagctgct

SEQ ID NO: 6211 - DNA, 20 bp, Artificial Sequence
  Description of Artificial Sequence: Synthetic oligonucleotide
aatcccacacagagctgctg

SEQ ID NO: 6212 - DNA, 20 bp, Artificial Sequence
  Description of Artificial Sequence: Synthetic oligonucleotide
atcccacacagagctgctgt

SEQ ID NO: 6213 - DNA, 20 bp, Artificial Sequence
  Description of Artificial Sequence: Synthetic oligonucleotide
tcccacacagagctgctgta

SEQ ID NO: 6214 - DNA, 20 bp, Artificial Sequence
  Description of Artificial Sequence: Synthetic oligonucleotide
cccacacagagctgctgtaa

SEQ ID NO: 6215 - DNA, 20 bp, Artificial Sequence
  Description of Artificial Sequence: Synthetic oligonucleotide
ccacacagagctgctgtaag

SEQ ID NO: 6216 - DNA, 20 bp, Artificial Sequence
  Description of Artificial Sequence: Synthetic oligonucleotide
cacacagagctgctgtaaga

SEQ ID NO: 6217 - DNA, 20 bp, Artificial Sequence
  Description of Artificial Sequence: Synthetic oligonucleotide
acacagagctgctgtaagag

SEQ ID NO: 6218 - DNA, 20 bp, Artificial Sequence
  Description of Artificial Sequence: Synthetic oligonucleotide
cacagagctgctgtaagaga

SEQ ID NO: 6219 - DNA, 20 bp, Artificial Sequence
  Description of Artificial Sequence: Synthetic oligonucleotide
acagagctgctgtaagagaa

SEQ ID NO: 6220 - DNA, 20 bp, Artificial Sequence
  Description of Artificial Sequence: Synthetic oligonucleotide
cagagctgctgtaagagaaa

SEQ ID NO: 6221 - DNA, 20 bp, Artificial Sequence
  Description of Artificial Sequence: Synthetic oligonucleotide
agagctgctgtaagagaaac

SEQ ID NO: 6222 - DNA, 20 bp, Artificial Sequence
  Description of Artificial Sequence: Synthetic oligonucleotide
gagctgctgtaagagaaaca

SEQ ID NO: 6223 - DNA, 20 bp, Artificial Sequence
  Description of Artificial Sequence: Synthetic oligonucleotide
agctgctgtaagagaaacat

SEQ ID NO: 6224 - DNA, 20 bp, Artificial Sequence
  Description of Artificial Sequence: Synthetic oligonucleotide
gctgctgtaagagaaacatg

SEQ ID NO: 6225 - DNA, 20 bp, Artificial Sequence
  Description of Artificial Sequence: Synthetic oligonucleotide
ctgctgtaagagaaacatga

SEQ ID NO: 6226 - DNA, 20 bp, Artificial Sequence
  Description of Artificial Sequence: Synthetic oligonucleotide
tgctgtaagagaaacatgag

SEQ ID NO: 6227 - DNA, 20 bp, Artificial Sequence
  Description of Artificial Sequence: Synthetic oligonucleotide
gctgtaagagaaacatgagg

SEQ ID NO: 6228 - DNA, 20 bp, Artificial Sequence
  Description of Artificial Sequence: Synthetic oligonucleotide
ctgtaagagaaacatgagga

SEQ ID NO: 6229 - DNA, 20 bp, Artificial Sequence
  Description of Artificial Sequence: Synthetic oligonucleotide
tgtaagagaaacatgaggat

SEQ ID NO: 6230 - DNA, 20 bp, Artificial Sequence
  Description of Artificial Sequence: Synthetic oligonucleotide
gtaagagaaacatgaggata

SEQ ID NO: 6231 - DNA, 20 bp, Artificial Sequence
  Description of Artificial Sequence: Synthetic oligonucleotide
taagagaaacatgaggatat

SEQ ID NO: 6232 - DNA, 20 bp, Artificial Sequence
  Description of Artificial Sequence: Synthetic oligonucleotide
aagagaaacatgaggatata

SEQ ID NO: 6233 - DNA, 20 bp, Artificial Sequence
  Description of Artificial Sequence: Synthetic oligonucleotide
agagaaacatgaggatatag

SEQ ID NO: 6234 - DNA, 20 bp, Artificial Sequence
  Description of Artificial Sequence: Synthetic oligonucleotide
gagaaacatgaggatatagt

SEQ ID NO: 6235 - DNA, 20 bp, Artificial Sequence
  Description of Artificial Sequence: Synthetic oligonucleotide
agaaacatgaggatatagtg

SEQ ID NO: 6236 - DNA, 20 bp, Artificial Sequence
  Description of Artificial Sequence: Synthetic oligonucleotide
gaaacatgaggatatagtga

SEQ ID NO: 6237 - DNA, 20 bp, Artificial Sequence
  Description of Artificial Sequence: Synthetic oligonucleotide
aaacatgaggatatagtgag

SEQ ID NO: 6238 - DNA, 20 bp, Artificial Sequence
  Description of Artificial Sequence: Synthetic oligonucleotide
aacatgaggatatagtgagt

SEQ ID NO: 6239 - DNA, 20 bp, Artificial Sequence
  Description of Artificial Sequence: Synthetic oligonucleotide
acatgaggatatagtgagtg

SEQ ID NO: 6240 - DNA, 20 bp, Artificial Sequence
  Description of Artificial Sequence: Synthetic oligonucleotide
catgaggatatagtgagtgc

SEQ ID NO: 6241 - DNA, 20 bp, Artificial Sequence
  Description of Artificial Sequence: Synthetic oligonucleotide
atgaggatatagtgagtgct

SEQ ID NO: 6242 - DNA, 20 bp, Artificial Sequence
  Description of Artificial Sequence: Synthetic oligonucleotide
tgaggatatagtgagtgctt

SEQ ID NO: 6243 - DNA, 20 bp, Artificial Sequence
  Description of Artificial Sequence: Synthetic oligonucleotide
gaggatatagtgagtgcttt

SEQ ID NO: 6244 - DNA, 20 bp, Artificial Sequence
  Description of Artificial Sequence: Synthetic oligonucleotide
aggatatagtgagtgctttc

SEQ ID NO: 6245 - DNA, 20 bp, Artificial Sequence
  Description of Artificial Sequence: Synthetic oligonucleotide
ggatatagtgagtgctttca

SEQ ID NO: 6246 - DNA, 20 bp, Artificial Sequence
  Description of Artificial Sequence: Synthetic oligonucleotide
gatatagtgagtgctttcag

SEQ ID NO: 6247 - DNA, 20 bp, Artificial Sequence
  Description of Artificial Sequence: Synthetic oligonucleotide
atatagtgagtgctttcaga

SEQ ID NO: 6248 - DNA, 20 bp, Artificial Sequence
  Description of Artificial Sequence: Synthetic oligonucleotide
tatagtgagtgctttcagac

SEQ ID NO: 6249 - DNA, 20 bp, Artificial Sequence
  Description of Artificial Sequence: Synthetic oligonucleotide
atagtgagtgctttcagacc

SEQ ID NO: 6250 - DNA, 20 bp, Artificial Sequence
  Description of Artificial Sequence: Synthetic oligonucleotide
tagtgagtgctttcagacct

SEQ ID NO: 6251 - DNA, 20 bp, Artificial Sequence
  Description of Artificial Sequence: Synthetic oligonucleotide
agtgagtgctttcagacctt

SEQ ID NO: 6252 - DNA, 20 bp, Artificial Sequence
  Description of Artificial Sequence: Synthetic oligonucleotide
gtgagtgctttcagaccttc

SEQ ID NO: 6253 - DNA, 20 bp, Artificial Sequence
  Description of Artificial Sequence: Synthetic oligonucleotide
tgagtgctttcagaccttca

SEQ ID NO: 6254 - DNA, 20 bp, Artificial Sequence
  Description of Artificial Sequence: Synthetic oligonucleotide
gagtgctttcagaccttcag

SEQ ID NO: 6255 - DNA, 20 bp, Artificial Sequence
  Description of Artificial Sequence: Synthetic oligonucleotide
agtgctttcagaccttcagc

SEQ ID NO: 6256 - DNA, 20 bp, Artificial Sequence
  Description of Artificial Sequence: Synthetic oligonucleotide
gtgctttcagaccttcagca

SEQ ID NO: 6257 - DNA, 20 bp, Artificial Sequence
  Description of Artificial Sequence: Synthetic oligonucleotide
tgctttcagaccttcagcaa

SEQ ID NO: 6258 - DNA, 20 bp, Artificial Sequence
  Description of Artificial Sequence: Synthetic oligonucleotide
gctttcagaccttcagcaag

SEQ ID NO: 6259 - DNA, 20 bp, Artificial Sequence
  Description of Artificial Sequence: Synthetic oligonucleotide
ctttcagaccttcagcaagg

SEQ ID NO: 6260 - DNA, 20 bp, Artificial Sequence
  Description of Artificial Sequence: Synthetic oligonucleotide
tttcagaccttcagcaaggg

SEQ ID NO: 6261 - DNA, 20 bp, Artificial Sequence
  Description of Artificial Sequence: Synthetic oligonucleotide
ttcagaccttcagcaagggt

SEQ ID NO: 6262 - DNA, 20 bp, Artificial Sequence
  Description of Artificial Sequence: Synthetic oligonucleotide
tcagaccttcagcaagggtc

SEQ ID NO: 6263 - DNA, 20 bp, Artificial Sequence
  Description of Artificial Sequence: Synthetic oligonucleotide
cagaccttcagcaagggtcc

SEQ ID NO: 6264 - DNA, 20 bp, Artificial Sequence
  Description of Artificial Sequence: Synthetic oligonucleotide
agaccttcagcaagggtccc

SEQ ID NO: 6265 - DNA, 20 bp, Artificial Sequence
  Description of Artificial Sequence: Synthetic oligonucleotide
gaccttcagcaagggtcccc

SEQ ID NO: 6266 - DNA, 20 bp, Artificial Sequence
  Description of Artificial Sequence: Synthetic oligonucleotide
accttcagcaagggtcccca

SEQ ID NO: 6267 - DNA, 20 bp, Artificial Sequence
  Description of Artificial Sequence: Synthetic oligonucleotide
ccttcagcaagggtccccaa

SEQ ID NO: 6268 - DNA, 20 bp, Artificial Sequence
  Description of Artificial Sequence: Synthetic oligonucleotide
cttcagcaagggtccccaaa

SEQ ID NO: 6269 - DNA, 20 bp, Artificial Sequence
  Description of Artificial Sequence: Synthetic oligonucleotide
ttcagcaagggtccccaaac

SEQ ID NO: 6270 - DNA, 20 bp, Artificial Sequence
  Description of Artificial Sequence: Synthetic oligonucleotide
tcagcaagggtccccaaaca

SEQ ID NO: 6271 - DNA, 20 bp, Artificial Sequence
  Description of Artificial Sequence: Synthetic oligonucleotide
cagcaagggtccccaaacag

SEQ ID NO: 6272 - DNA, 20 bp, Artificial Sequence
  Description of Artificial Sequence: Synthetic oligonucleotide
agcaagggtccccaaacagt

SEQ ID NO: 6273 - DNA, 20 bp, Artificial Sequence
  Description of Artificial Sequence: Synthetic oligonucleotide
gcaagggtccccaaacagta

SEQ ID NO: 6274 - DNA, 20 bp, Artificial Sequence
  Description of Artificial Sequence: Synthetic oligonucleotide
caagggtccccaaacagtat

SEQ ID NO: 6275 - DNA, 20 bp, Artificial Sequence
  Description of Artificial Sequence: Synthetic oligonucleotide
aagggtccccaaacagtatc

SEQ ID NO: 6276 - DNA, 20 bp, Artificial Sequence
  Description of Artificial Sequence: Synthetic oligonucleotide
agggtccccaaacagtatca

SEQ ID NO: 6277 - DNA, 20 bp, Artificial Sequence
  Description of Artificial Sequence: Synthetic oligonucleotide
gggtccccaaacagtatcag

SEQ ID NO: 6278 - DNA, 20 bp, Artificial Sequence
  Description of Artificial Sequence: Synthetic oligonucleotide
ggtccccaaacagtatcagt

SEQ ID NO: 6279 - DNA, 20 bp, Artificial Sequence
  Description of Artificial Sequence: Synthetic oligonucleotide
gtccccaaacagtatcagta

SEQ ID NO: 6280 - DNA, 20 bp, Artificial Sequence
  Description of Artificial Sequence: Synthetic oligonucleotide
tccccaaacagtatcagtaa

SEQ ID NO: 6281 - DNA, 20 bp, Artificial Sequence
  Description of Artificial Sequence: Synthetic oligonucleotide
ccccaaacagtatcagtaag

SEQ ID NO: 6282 - DNA, 20 bp, Artificial Sequence
  Description of Artificial Sequence: Synthetic oligonucleotide
cccaaacagtatcagtaaga

SEQ ID NO: 6283 - DNA, 20 bp, Artificial Sequence
  Description of Artificial Sequence: Synthetic oligonucleotide
ccaaacagtatcagtaagat

SEQ ID NO: 6284 - DNA, 20 bp, Artificial Sequence
  Description of Artificial Sequence: Synthetic oligonucleotide
caaacagtatcagtaagatt

SEQ ID NO: 6285 - DNA, 20 bp, Artificial Sequence
  Description of Artificial Sequence: Synthetic oligonucleotide
aaacagtatcagtaagattt

SEQ ID NO: 6286 - DNA, 20 bp, Artificial Sequence
  Description of Artificial Sequence: Synthetic oligonucleotide
aacagtatcagtaagatttg

SEQ ID NO: 6287 - DNA, 20 bp, Artificial Sequence
  Description of Artificial Sequence: Synthetic oligonucleotide
acagtatcagtaagatttgc

SEQ ID NO: 6288 - DNA, 20 bp, Artificial Sequence
  Description of Artificial Sequence: Synthetic oligonucleotide
cagtatcagtaagatttgca

SEQ ID NO: 6289 - DNA, 20 bp, Artificial Sequence
  Description of Artificial Sequence: Synthetic oligonucleotide
agtatcagtaagatttgcac

SEQ ID NO: 6290 - DNA, 20 bp, Artificial Sequence
  Description of Artificial Sequence: Synthetic oligonucleotide
gtatcagtaagatttgcacc

SEQ ID NO: 6291 - DNA, 20 bp, Artificial Sequence
  Description of Artificial Sequence: Synthetic oligonucleotide
tatcagtaagatttgcacct

SEQ ID NO: 6292 - DNA, 20 bp, Artificial Sequence
  Description of Artificial Sequence: Synthetic oligonucleotide
atcagtaagatttgcaccta

SEQ ID NO: 6293 - DNA, 20 bp, Artificial Sequence
  Description of Artificial Sequence: Synthetic oligonucleotide
tcagtaagatttgcacctaa

SEQ ID NO: 6294 - DNA, 20 bp, Artificial Sequence
  Description of Artificial Sequence: Synthetic oligonucleotide
cagtaagatttgcacctaaa

SEQ ID NO: 6295 - DNA, 20 bp, Artificial Sequence
  Description of Artificial Sequence: Synthetic oligonucleotide
agtaagatttgcacctaaag

SEQ ID NO: 6296 - DNA, 20 bp, Artificial Sequence
  Description of Artificial Sequence: Synthetic oligonucleotide
gtaagatttgcacctaaagg

SEQ ID NO: 6297 - DNA, 20 bp, Artificial Sequence
  Description of Artificial Sequence: Synthetic oligonucleotide
taagatttgcacctaaagga

SEQ ID NO: 6298 - DNA, 20 bp, Artificial Sequence
  Description of Artificial Sequence: Synthetic oligonucleotide
aagatttgcacctaaaggac

SEQ ID NO: 6299 - DNA, 20 bp, Artificial Sequence
  Description of Artificial Sequence: Synthetic oligonucleotide
agatttgcacctaaaggacc

SEQ ID NO: 6300 - DNA, 20 bp, Artificial Sequence
  Description of Artificial Sequence: Synthetic oligonucleotide
gatttgcacctaaaggacct

SEQ ID NO: 6301 - DNA, 20 bp, Artificial Sequence
  Description of Artificial Sequence: Synthetic oligonucleotide
atttgcacctaaaggacctc

SEQ ID NO: 6302 - DNA, 20 bp, Artificial Sequence
  Description of Artificial Sequence: Synthetic oligonucleotide
tttgcacctaaaggacctca

SEQ ID NO: 6303 - DNA, 20 bp, Artificial Sequence
  Description of Artificial Sequence: Synthetic oligonucleotide
ttgcacctaaaggacctcat

SEQ ID NO: 6304 - DNA, 20 bp, Artificial Sequence
  Description of Artificial Sequence: Synthetic oligonucleotide
tgcacctaaaggacctcatg

SEQ ID NO: 6305 - DNA, 20 bp, Artificial Sequence
  Description of Artificial Sequence: Synthetic oligonucleotide
gcacctaaaggacctcatgc

SEQ ID NO: 6306 - DNA, 20 bp, Artificial Sequence
  Description of Artificial Sequence: Synthetic oligonucleotide
cacctaaaggacctcatgct

SEQ ID NO: 6307 - DNA, 20 bp, Artificial Sequence
  Description of Artificial Sequence: Synthetic oligonucleotide
acctaaaggacctcatgctc

SEQ ID NO: 6308 - DNA, 20 bp, Artificial Sequence
  Description of Artificial Sequence: Synthetic oligonucleotide
cctaaaggacctcatgctcg

SEQ ID NO: 6309 - DNA, 20 bp, Artificial Sequence
  Description of Artificial Sequence: Synthetic oligonucleotide
ctaaaggacctcatgctcgg

SEQ ID NO: 6310 - DNA, 20 bp, Artificial Sequence
  Description of Artificial Sequence: Synthetic oligonucleotide
taaaggacctcatgctcggc

SEQ ID NO: 6311 - DNA, 20 bp, Artificial Sequence
  Description of Artificial Sequence: Synthetic oligonucleotide
aaaggacctcatgctcggcc

SEQ ID NO: 6312 - DNA, 20 bp, Artificial Sequence
  Description of Artificial Sequence: Synthetic oligonucleotide
aaggacctcatgctcggcca

SEQ ID NO: 6313 - DNA, 20 bp, Artificial Sequence
  Description of Artificial Sequence: Synthetic oligonucleotide
aggacctcatgctcggccag

SEQ ID NO: 6314 - DNA, 20 bp, Artificial Sequence
  Description of Artificial Sequence: Synthetic oligonucleotide
ggacctcatgctcggccaga

SEQ ID NO: 6315 - DNA, 20 bp, Artificial Sequence
  Description of Artificial Sequence: Synthetic oligonucleotide
gacctcatgctcggccagag

SEQ ID NO: 6316 - DNA, 20 bp, Artificial Sequence
  Description of Artificial Sequence: Synthetic oligonucleotide
acctcatgctcggccagagc

SEQ ID NO: 6317 - DNA, 20 bp, Artificial Sequence
  Description of Artificial Sequence: Synthetic oligonucleotide
cctcatgctcggccagagca

SEQ ID NO: 6318 - DNA, 20 bp, Artificial Sequence
  Description of Artificial Sequence: Synthetic oligonucleotide
ctcatgctcggccagagcag

SEQ ID NO: 6319 - DNA, 20 bp, Artificial Sequence
  Description of Artificial Sequence: Synthetic oligonucleotide
tcatgctcggccagagcaga

SEQ ID NO: 6320 - DNA, 20 bp, Artificial Sequence
  Description of Artificial Sequence: Synthetic oligonucleotide
catgctcggccagagcagag

SEQ ID NO: 6321 - DNA, 20 bp, Artificial Sequence
  Description of Artificial Sequence: Synthetic oligonucleotide
atgctcggccagagcagaga

SEQ ID NO: 6322 - DNA, 20 bp, Artificial Sequence
  Description of Artificial Sequence: Synthetic oligonucleotide
tgctcggccagagcagagac

SEQ ID NO: 6323 - DNA, 20 bp, Artificial Sequence
  Description of Artificial Sequence: Synthetic oligonucleotide
gctcggccagagcagagact

SEQ ID NO: 6324 - DNA, 20 bp, Artificial Sequence
  Description of Artificial Sequence: Synthetic oligonucleotide
ctcggccagagcagagacta

SEQ ID NO: 6325 - DNA, 20 bp, Artificial Sequence
  Description of Artificial Sequence: Synthetic oligonucleotide
tcggccagagcagagactag

SEQ ID NO: 6326 - DNA, 20 bp, Artificial Sequence
  Description of Artificial Sequence: Synthetic oligonucleotide
cggccagagcagagactagt

SEQ ID NO: 6327 - DNA, 20 bp, Artificial Sequence
  Description of Artificial Sequence: Synthetic oligonucleotide
ggccagagcagagactagtg

SEQ ID NO: 6328 - DNA, 20 bp, Artificial Sequence
  Description of Artificial Sequence: Synthetic oligonucleotide
gccagagcagagactagtgt

SEQ ID NO: 6329 - DNA, 20 bp, Artificial Sequence
  Description of Artificial Sequence: Synthetic oligonucleotide
ccagagcagagactagtgtt

SEQ ID NO: 6330 - DNA, 20 bp, Artificial Sequence
  Description of Artificial Sequence: Synthetic oligonucleotide
cagagcagagactagtgttc

SEQ ID NO: 6331 - DNA, 20 bp, Artificial Sequence
  Description of Artificial Sequence: Synthetic oligonucleotide
agagcagagactagtgttcg

SEQ ID NO: 6332 - DNA, 20 bp, Artificial Sequence
  Description of Artificial Sequence: Synthetic oligonucleotide
gagcagagactagtgttcgg

SEQ ID NO: 6333 - DNA, 20 bp, Artificial Sequence
  Description of Artificial Sequence: Synthetic oligonucleotide
agcagagactagtgttcggc

SEQ ID NO: 6334 - DNA, 20 bp, Artificial Sequence
  Description of Artificial Sequence: Synthetic oligonucleotide
gcagagactagtgttcggca

SEQ ID NO: 6335 - DNA, 20 bp, Artificial Sequence
  Description of Artificial Sequence: Synthetic oligonucleotide
cagagactagtgttcggcac

SEQ ID NO: 6336 - DNA, 20 bp, Artificial Sequence
  Description of Artificial Sequence: Synthetic oligonucleotide
agagactagtgttcggcaca

SEQ ID NO: 6337 - DNA, 20 bp, Artificial Sequence
  Description of Artificial Sequence: Synthetic oligonucleotide
gagactagtgttcggcacag

SEQ ID NO: 6338 - DNA, 20 bp, Artificial Sequence
  Description of Artificial Sequence: Synthetic oligonucleotide
agactagtgttcggcacagc

SEQ ID NO: 6339 - DNA, 20 bp, Artificial Sequence
  Description of Artificial Sequence: Synthetic oligonucleotide
gactagtgttcggcacagct

SEQ ID NO: 6340 - DNA, 20 bp, Artificial Sequence
  Description of Artificial Sequence: Synthetic oligonucleotide
actagtgttcggcacagctg

SEQ ID NO: 6341 - DNA, 20 bp, Artificial Sequence
  Description of Artificial Sequence: Synthetic oligonucleotide
ctagtgttcggcacagctga

SEQ ID NO: 6342 - DNA, 20 bp, Artificial Sequence
  Description of Artificial Sequence: Synthetic oligonucleotide
tagtgttcggcacagctgac

SEQ ID NO: 6343 - DNA, 20 bp, Artificial Sequence
  Description of Artificial Sequence: Synthetic oligonucleotide
agtgttcggcacagctgact

SEQ ID NO: 6344 - DNA, 20 bp, Artificial Sequence
  Description of Artificial Sequence: Synthetic oligonucleotide
gtgttcggcacagctgactg

SEQ ID NO: 6345 - DNA, 20 bp, Artificial Sequence
  Description of Artificial Sequence: Synthetic oligonucleotide
tgttcggcacagctgactgt

SEQ ID NO: 6346 - DNA, 20 bp, Artificial Sequence
  Description of Artificial Sequence: Synthetic oligonucleotide
gttcggcacagctgactgtt

SEQ ID NO: 6347 - DNA, 20 bp, Artificial Sequence
  Description of Artificial Sequence: Synthetic oligonucleotide
ttcggcacagctgactgttg

SEQ ID NO: 6348 - DNA, 20 bp, Artificial Sequence
  Description of Artificial Sequence: Synthetic oligonucleotide
tcggcacagctgactgttga

SEQ ID NO: 6349 - DNA, 20 bp, Artificial Sequence
  Description of Artificial Sequence: Synthetic oligonucleotide
cggcacagctgactgttgaa

SEQ ID NO: 6350 - DNA, 20 bp, Artificial Sequence
  Description of Artificial Sequence: Synthetic oligonucleotide
ggcacagctgactgttgaat

SEQ ID NO: 6351 - DNA, 20 bp, Artificial Sequence
  Description of Artificial Sequence: Synthetic oligonucleotide
gcacagctgactgttgaatt

SEQ ID NO: 6352 - DNA, 20 bp, Artificial Sequence
  Description of Artificial Sequence: Synthetic oligonucleotide
cacagctgactgttgaattt

SEQ ID NO: 6353 - DNA, 20 bp, Artificial Sequence
  Description of Artificial Sequence: Synthetic oligonucleotide
acagctgactgttgaatttg

SEQ ID NO: 6354 - DNA, 20 bp, Artificial Sequence
  Description of Artificial Sequence: Synthetic oligonucleotide
cagctgactgttgaatttgc

SEQ ID NO: 6355 - DNA, 20 bp, Artificial Sequence
  Description of Artificial Sequence: Synthetic oligonucleotide
agctgactgttgaatttgct

SEQ ID NO: 6356 - DNA, 20 bp, Artificial Sequence
  Description of Artificial Sequence: Synthetic oligonucleotide
gctgactgttgaatttgctc

SEQ ID NO: 6357 - DNA, 20 bp, Artificial Sequence
  Description of Artificial Sequence: Synthetic oligonucleotide
ctgactgttgaatttgctct

SEQ ID NO: 6358 - DNA, 20 bp, Artificial Sequence
  Description of Artificial Sequence: Synthetic oligonucleotide
tgactgttgaatttgctcta

SEQ ID NO: 6359 - DNA, 20 bp, Artificial Sequence
  Description of Artificial Sequence: Synthetic oligonucleotide
gactgttgaatttgctctac

SEQ ID NO: 6360 - DNA, 20 bp, Artificial Sequence
  Description of Artificial Sequence: Synthetic oligonucleotide
actgttgaatttgctctact

SEQ ID NO: 6361 - DNA, 20 bp, Artificial Sequence
  Description of Artificial Sequence: Synthetic oligonucleotide
ctgttgaatttgctctactc

SEQ ID NO: 6362 - DNA, 20 bp, Artificial Sequence
  Description of Artificial Sequence: Synthetic oligonucleotide
tgttgaatttgctctactct

SEQ ID NO: 6363 - DNA, 20 bp, Artificial Sequence
  Description of Artificial Sequence: Synthetic oligonucleotide
gttgaatttgctctactctg

SEQ ID NO: 6364 - DNA, 20 bp, Artificial Sequence
  Description of Artificial Sequence: Synthetic oligonucleotide
ttgaatttgctctactctgg

SEQ ID NO: 6365 - DNA, 20 bp, Artificial Sequence
  Description of Artificial Sequence: Synthetic oligonucleotide
tgaatttgctctactctggc

SEQ ID NO: 6366 - DNA, 20 bp, Artificial Sequence
  Description of Artificial Sequence: Synthetic oligonucleotide
gaatttgctctactctggcc

SEQ ID NO: 6367 - DNA, 20 bp, Artificial Sequence
  Description of Artificial Sequence: Synthetic oligonucleotide
aatttgctctactctggcct

SEQ ID NO: 6368 - DNA, 20 bp, Artificial Sequence
  Description of Artificial Sequence: Synthetic oligonucleotide
atttgctctactctggcctg

SEQ ID NO: 6369 - DNA, 20 bp, Artificial Sequence
  Description of Artificial Sequence: Synthetic oligonucleotide
tttgctctactctggcctgg

SEQ ID NO: 6370 - DNA, 20 bp, Artificial Sequence
  Description of Artificial Sequence: Synthetic oligonucleotide
ttgctctactctggcctggg

SEQ ID NO: 6371 - DNA, 20 bp, Artificial Sequence
  Description of Artificial Sequence: Synthetic oligonucleotide
tgctctactctggcctgggt

SEQ ID NO: 6372 - DNA, 20 bp, Artificial Sequence
  Description of Artificial Sequence: Synthetic oligonucleotide
gctctactctggcctgggtc

SEQ ID NO: 6373 - DNA, 20 bp, Artificial Sequence
  Description of Artificial Sequence: Synthetic oligonucleotide
ctctactctggcctgggtct

SEQ ID NO: 6374 - DNA, 20 bp, Artificial Sequence
  Description of Artificial Sequence: Synthetic oligonucleotide
tctactctggcctgggtctg

SEQ ID NO: 6375 - DNA, 20 bp, Artificial Sequence
  Description of Artificial Sequence: Synthetic oligonucleotide
ctactctggcctgggtctgg

SEQ ID NO: 6376 - DNA, 20 bp, Artificial Sequence
  Description of Artificial Sequence: Synthetic oligonucleotide
tactctggcctgggtctggc

SEQ ID NO: 6377 - DNA, 20 bp, Artificial Sequence
  Description of Artificial Sequence: Synthetic oligonucleotide
actctggcctgggtctggcc

SEQ ID NO: 6378 - DNA, 20 bp, Artificial Sequence
  Description of Artificial Sequence: Synthetic oligonucleotide
ctctggcctgggtctggcct

SEQ ID NO: 6379 - DNA, 20 bp, Artificial Sequence
  Description of Artificial Sequence: Synthetic oligonucleotide
tctggcctgggtctggcctc

SEQ ID NO: 6380 - DNA, 20 bp, Artificial Sequence
  Description of Artificial Sequence: Synthetic oligonucleotide
ctggcctgggtctggcctct

SEQ ID NO: 6381 - DNA, 20 bp, Artificial Sequence
  Description of Artificial Sequence: Synthetic oligonucleotide
tggcctgggtctggcctctt

SEQ ID NO: 6382 - DNA, 20 bp, Artificial Sequence
  Description of Artificial Sequence: Synthetic oligonucleotide
ggcctgggtctggcctcttc

SEQ ID NO: 6383 - DNA, 20 bp, Artificial Sequence
  Description of Artificial Sequence: Synthetic oligonucleotide
gcctgggtctggcctcttcc

SEQ ID NO: 6384 - DNA, 20 bp, Artificial Sequence
  Description of Artificial Sequence: Synthetic oligonucleotide
cctgggtctggcctcttcct

SEQ ID NO: 6385 - DNA, 20 bp, Artificial Sequence
  Description of Artificial Sequence: Synthetic oligonucleotide
ctgggtctggcctcttcctg

SEQ ID NO: 6386 - DNA, 20 bp, Artificial Sequence
  Description of Artificial Sequence: Synthetic oligonucleotide
tgggtctggcctcttcctgt

SEQ ID NO: 6387 - DNA, 20 bp, Artificial Sequence
  Description of Artificial Sequence: Synthetic oligonucleotide
gggtctggcctcttcctgtc

SEQ ID NO: 6388 - DNA, 20 bp, Artificial Sequence
  Description of Artificial Sequence: Synthetic oligonucleotide
ggtctggcctcttcctgtcc

SEQ ID NO: 6389 - DNA, 20 bp, Artificial Sequence
  Description of Artificial Sequence: Synthetic oligonucleotide
gtctggcctcttcctgtccc

SEQ ID NO: 6390 - DNA, 20 bp, Artificial Sequence
  Description of Artificial Sequence: Synthetic oligonucleotide
tctggcctcttcctgtccca

SEQ ID NO: 6391 - DNA, 20 bp, Artificial Sequence
  Description of Artificial Sequence: Synthetic oligonucleotide
ctggcctcttcctgtcccac

SEQ ID NO: 6392 - DNA, 20 bp, Artificial Sequence
  Description of Artificial Sequence: Synthetic oligonucleotide
tggcctcttcctgtcccacc

SEQ ID NO: 6393 - DNA, 20 bp, Artificial Sequence
  Description of Artificial Sequence: Synthetic oligonucleotide
ggcctcttcctgtcccacct

SEQ ID NO: 6394 - DNA, 20 bp, Artificial Sequence
  Description of Artificial Sequence: Synthetic oligonucleotide
gcctcttcctgtcccacctg

SEQ ID NO: 6395 - DNA, 20 bp, Artificial Sequence
  Description of Artificial Sequence: Synthetic oligonucleotide
cctcttcctgtcccacctgc

SEQ ID NO: 6396 - DNA, 20 bp, Artificial Sequence
  Description of Artificial Sequence: Synthetic oligonucleotide
ctcttcctgtcccacctgca

SEQ ID NO: 6397 - DNA, 20 bp, Artificial Sequence
  Description of Artificial Sequence: Synthetic oligonucleotide
tcttcctgtcccacctgcag

SEQ ID NO: 6398 - DNA, 20 bp, Artificial Sequence
  Description of Artificial Sequence: Synthetic oligonucleotide
cttcctgtcccacctgcagc

SEQ ID NO: 6399 - DNA, 20 bp, Artificial Sequence
  Description of Artificial Sequence: Synthetic oligonucleotide
ttcctgtcccacctgcagcc

SEQ ID NO: 6400 - DNA, 20 bp, Artificial Sequence
  Description of Artificial Sequence: Synthetic oligonucleotide
tcctgtcccacctgcagccc

SEQ ID NO: 6401 - DNA, 20 bp, Artificial Sequence
  Description of Artificial Sequence: Synthetic oligonucleotide
cctgtcccacctgcagcccc

SEQ ID NO: 6402 - DNA, 20 bp, Artificial Sequence
  Description of Artificial Sequence: Synthetic oligonucleotide
ctgtcccacctgcagcccca

SEQ ID NO: 6403 - DNA, 20 bp, Artificial Sequence
  Description of Artificial Sequence: Synthetic oligonucleotide
tgtcccacctgcagccccac

SEQ ID NO: 6404 - DNA, 20 bp, Artificial Sequence
  Description of Artificial Sequence: Synthetic oligonucleotide
gtcccacctgcagccccact

SEQ ID NO: 6405 - DNA, 20 bp, Artificial Sequence
  Description of Artificial Sequence: Synthetic oligonucleotide
tcccacctgcagccccactt

SEQ ID NO: 6406 - DNA, 20 bp, Artificial Sequence
  Description of Artificial Sequence: Synthetic oligonucleotide
cccacctgcagccccacttt

SEQ ID NO: 6407 - DNA, 20 bp, Artificial Sequence
  Description of Artificial Sequence: Synthetic oligonucleotide
ccacctgcagccccactttt

SEQ ID NO: 6408 - DNA, 20 bp, Artificial Sequence
  Description of Artificial Sequence: Synthetic oligonucleotide
cacctgcagccccacttttg

SEQ ID NO: 6409 - DNA, 20 bp, Artificial Sequence
  Description of Artificial Sequence: Synthetic oligonucleotide
acctgcagccccacttttgt

SEQ ID NO: 6410 - DNA, 20 bp, Artificial Sequence
  Description of Artificial Sequence: Synthetic oligonucleotide
cctgcagccccacttttgtc

SEQ ID NO: 6411 - DNA, 20 bp, Artificial Sequence
  Description of Artificial Sequence: Synthetic oligonucleotide
ctgcagccccacttttgtcg

SEQ ID NO: 6412 - DNA, 20 bp, Artificial Sequence
  Description of Artificial Sequence: Synthetic oligonucleotide
tgcagccccacttttgtcgg

SEQ ID NO: 6413 - DNA, 20 bp, Artificial Sequence
  Description of Artificial Sequence: Synthetic oligonucleotide
gcagccccacttttgtcggg

SEQ ID NO: 6414 - DNA, 20 bp, Artificial Sequence
  Description of Artificial Sequence: Synthetic oligonucleotide
cagccccacttttgtcgggg

SEQ ID NO: 6415 - DNA, 20 bp, Artificial Sequence
  Description of Artificial Sequence: Synthetic oligonucleotide
agccccacttttgtcggggg

SEQ ID NO: 6416 - DNA, 20 bp, Artificial Sequence
  Description of Artificial Sequence: Synthetic oligonucleotide
gccccacttttgtcgggggg

SEQ ID NO: 6417 - DNA, 20 bp, Artificial Sequence
  Description of Artificial Sequence: Synthetic oligonucleotide
ccccacttttgtcggggggt

SEQ ID NO: 6418 - DNA, 20 bp, Artificial Sequence
  Description of Artificial Sequence: Synthetic oligonucleotide
cccacttttgtcggggggtt

SEQ ID NO: 6419 - DNA, 20 bp, Artificial Sequence
  Description of Artificial Sequence: Synthetic oligonucleotide
ccacttttgtcggggggttg

SEQ ID NO: 6420 - DNA, 20 bp, Artificial Sequence
  Description of Artificial Sequence: Synthetic oligonucleotide
cacttttgtcggggggttgg

SEQ ID NO: 6421 - DNA, 20 bp, Artificial Sequence
  Description of Artificial Sequence: Synthetic oligonucleotide
acttttgtcggggggttggg

SEQ ID NO: 6422 - DNA, 20 bp, Artificial Sequence
  Description of Artificial Sequence: Synthetic oligonucleotide
cttttgtcggggggttgggg

SEQ ID NO: 6423 - DNA, 20 bp, Artificial Sequence
  Description of Artificial Sequence: Synthetic oligonucleotide
ttttgtcggggggttggggg

SEQ ID NO: 6424 - DNA, 20 bp, Artificial Sequence
  Description of Artificial Sequence: Synthetic oligonucleotide
tttgtcggggggttgggggg

SEQ ID NO: 6425 - DNA, 20 bp, Artificial Sequence
  Description of Artificial Sequence: Synthetic oligonucleotide
ttgtcggggggttggggggg

SEQ ID NO: 6426 - DNA, 20 bp, Artificial Sequence
  Description of Artificial Sequence: Synthetic oligonucleotide
tgtcggggggttgggggggt

SEQ ID NO: 6427 - DNA, 20 bp, Artificial Sequence
  Description of Artificial Sequence: Synthetic oligonucleotide
gtcggggggttgggggggtt

SEQ ID NO: 6428 - DNA, 20 bp, Artificial Sequence
  Description of Artificial Sequence: Synthetic oligonucleotide
tcggggggttgggggggttg

SEQ ID NO: 6429 - DNA, 20 bp, Artificial Sequence
  Description of Artificial Sequence: Synthetic oligonucleotide
cggggggttgggggggttgc

SEQ ID NO: 6430 - DNA, 20 bp, Artificial Sequence
  Description of Artificial Sequence: Synthetic oligonucleotide
ggggggttgggggggttgca

SEQ ID NO: 6431 - DNA, 20 bp, Artificial Sequence
  Description of Artificial Sequence: Synthetic oligonucleotide
gggggttgggggggttgcag

SEQ ID NO: 6432 - DNA, 20 bp, Artificial Sequence
  Description of Artificial Sequence: Synthetic oligonucleotide
ggggttgggggggttgcaga

SEQ ID NO: 6433 - DNA, 20 bp, Artificial Sequence
  Description of Artificial Sequence: Synthetic oligonucleotide
gggttgggggggttgcagaa

SEQ ID NO: 6434 - DNA, 20 bp, Artificial Sequence
  Description of Artificial Sequence: Synthetic oligonucleotide
ggttgggggggttgcagaaa

SEQ ID NO: 6435 - DNA, 20 bp, Artificial Sequence
  Description of Artificial Sequence: Synthetic oligonucleotide
gttgggggggttgcagaaag

SEQ ID NO: 6436 - DNA, 20 bp, Artificial Sequence
  Description of Artificial Sequence: Synthetic oligonucleotide
ttgggggggttgcagaaagg

SEQ ID NO: 6437 - DNA, 20 bp, Artificial Sequence
  Description of Artificial Sequence: Synthetic oligonucleotide
tgggggggttgcagaaagga

SEQ ID NO: 6438 - DNA, 20 bp, Artificial Sequence
  Description of Artificial Sequence: Synthetic oligonucleotide
gggggggttgcagaaaggaa

SEQ ID NO: 6439 - DNA, 20 bp, Artificial Sequence
  Description of Artificial Sequence: Synthetic oligonucleotide
ggggggttgcagaaaggaaa

SEQ ID NO: 6440 - DNA, 20 bp, Artificial Sequence
  Description of Artificial Sequence: Synthetic oligonucleotide
gggggttgcagaaaggaaaa

SEQ ID NO: 6441 - DNA, 20 bp, Artificial Sequence
  Description of Artificial Sequence: Synthetic oligonucleotide
ggggttgcagaaaggaaaaa

SEQ ID NO: 6442 - DNA, 20 bp, Artificial Sequence
  Description of Artificial Sequence: Synthetic oligonucleotide
gggttgcagaaaggaaaaat

SEQ ID NO: 6443 - DNA, 20 bp, Artificial Sequence
  Description of Artificial Sequence: Synthetic oligonucleotide
ggttgcagaaaggaaaaata

SEQ ID NO: 6444 - DNA, 20 bp, Artificial Sequence
  Description of Artificial Sequence: Synthetic oligonucleotide
gttgcagaaaggaaaaatac

SEQ ID NO: 6445 - DNA, 20 bp, Artificial Sequence
  Description of Artificial Sequence: Synthetic oligonucleotide
ttgcagaaaggaaaaatacc

SEQ ID NO: 6446 - DNA, 20 bp, Artificial Sequence
  Description of Artificial Sequence: Synthetic oligonucleotide
tgcagaaaggaaaaatacct

SEQ ID NO: 6447 - DNA, 20 bp, Artificial Sequence
  Description of Artificial Sequence: Synthetic oligonucleotide
gcagaaaggaaaaataccta

SEQ ID NO: 6448 - DNA, 20 bp, Artificial Sequence
  Description of Artificial Sequence: Synthetic oligonucleotide
cagaaaggaaaaatacctat

SEQ ID NO: 6449 - DNA, 20 bp, Artificial Sequence
  Description of Artificial Sequence: Synthetic oligonucleotide
agaaaggaaaaatacctatt

SEQ ID NO: 6450 - DNA, 20 bp, Artificial Sequence
  Description of Artificial Sequence: Synthetic oligonucleotide
gaaaggaaaaatacctattt

SEQ ID NO: 6451 - DNA, 20 bp, Artificial Sequence
  Description of Artificial Sequence: Synthetic oligonucleotide
aaaggaaaaatacctatttt

SEQ ID NO: 6452 - DNA, 20 bp, Artificial Sequence
  Description of Artificial Sequence: Synthetic oligonucleotide
aaggaaaaatacctattttt

SEQ ID NO: 6453 - DNA, 20 bp, Artificial Sequence
  Description of Artificial Sequence: Synthetic oligonucleotide
aggaaaaatacctatttttc

SEQ ID NO: 6454 - DNA, 20 bp, Artificial Sequence
  Description of Artificial Sequence: Synthetic oligonucleotide
ggaaaaatacctatttttcc

SEQ ID NO: 6455 - DNA, 20 bp, Artificial Sequence
  Description of Artificial Sequence: Synthetic oligonucleotide
gaaaaatacctatttttcct

SEQ ID NO: 6456 - DNA, 20 bp, Artificial Sequence
  Description of Artificial Sequence: Synthetic oligonucleotide
aaaaatacctatttttcctc

SEQ ID NO: 6457 - DNA, 20 bp, Artificial Sequence
  Description of Artificial Sequence: Synthetic oligonucleotide
aaaatacctatttttcctca

SEQ ID NO: 6458 - DNA, 20 bp, Artificial Sequence
  Description of Artificial Sequence: Synthetic oligonucleotide
aaatacctatttttcctcaa

SEQ ID NO: 6459 - DNA, 20 bp, Artificial Sequence
  Description of Artificial Sequence: Synthetic oligonucleotide
aatacctatttttcctcaac

SEQ ID NO: 6460 - DNA, 20 bp, Artificial Sequence
  Description of Artificial Sequence: Synthetic oligonucleotide
atacctatttttcctcaact

SEQ ID NO: 6461 - DNA, 20 bp, Artificial Sequence
  Description of Artificial Sequence: Synthetic oligonucleotide
tacctatttttcctcaactc

SEQ ID NO: 6462 - DNA, 20 bp, Artificial Sequence
  Description of Artificial Sequence: Synthetic oligonucleotide
acctatttttcctcaactcc

SEQ ID NO: 6463 - DNA, 20 bp, Artificial Sequence
  Description of Artificial Sequence: Synthetic oligonucleotide
cctatttttcctcaactcca

SEQ ID NO: 6464 - DNA, 20 bp, Artificial Sequence
  Description of Artificial Sequence: Synthetic oligonucleotide
ctatttttcctcaactccat

SEQ ID NO: 6465 - DNA, 20 bp, Artificial Sequence
  Description of Artificial Sequence: Synthetic oligonucleotide
tatttttcctcaactccatt

SEQ ID NO: 6466 - DNA, 20 bp, Artificial Sequence
  Description of Artificial Sequence: Synthetic oligonucleotide
atttttcctcaactccatta

SEQ ID NO: 6467 - DNA, 20 bp, Artificial Sequence
  Description of Artificial Sequence: Synthetic oligonucleotide
tttttcctcaactccattac

SEQ ID NO: 6468 - DNA, 20 bp, Artificial Sequence
  Description of Artificial Sequence: Synthetic oligonucleotide
ttttcctcaactccattaca

SEQ ID NO: 6469 - DNA, 20 bp, Artificial Sequence
  Description of Artificial Sequence: Synthetic oligonucleotide
tttcctcaactccattacaa

SEQ ID NO: 6470 - DNA, 20 bp, Artificial Sequence
  Description of Artificial Sequence: Synthetic oligonucleotide
ttcctcaactccattacaac

SEQ ID NO: 6471 - DNA, 20 bp, Artificial Sequence
  Description of Artificial Sequence: Synthetic oligonucleotide
tcctcaactccattacaact

SEQ ID NO: 6472 - DNA, 20 bp, Artificial Sequence
  Description of Artificial Sequence: Synthetic oligonucleotide
cctcaactccattacaactt

SEQ ID NO: 6473 - DNA, 20 bp, Artificial Sequence
  Description of Artificial Sequence: Synthetic oligonucleotide
ctcaactccattacaacttg

SEQ ID NO: 6474 - DNA, 20 bp, Artificial Sequence
  Description of Artificial Sequence: Synthetic oligonucleotide
tcaactccattacaacttgc

SEQ ID NO: 6475 - DNA, 20 bp, Artificial Sequence
  Description of Artificial Sequence: Synthetic oligonucleotide
caactccattacaacttgca

SEQ ID NO: 6476 - DNA, 20 bp, Artificial Sequence
  Description of Artificial Sequence: Synthetic oligonucleotide
aactccattacaacttgcag

SEQ ID NO: 6477 - DNA, 20 bp, Artificial Sequence
  Description of Artificial Sequence: Synthetic oligonucleotide
actccattacaacttgcagg

SEQ ID NO: 6478 - DNA, 20 bp, Artificial Sequence
  Description of Artificial Sequence: Synthetic oligonucleotide
ctccattacaacttgcagga

SEQ ID NO: 6479 - DNA, 20 bp, Artificial Sequence
  Description of Artificial Sequence: Synthetic oligonucleotide
tccattacaacttgcaggaa

SEQ ID NO: 6480 - DNA, 20 bp, Artificial Sequence
  Description of Artificial Sequence: Synthetic oligonucleotide
ccattacaacttgcaggaaa

SEQ ID NO: 6481 - DNA, 20 bp, Artificial Sequence
  Description of Artificial Sequence: Synthetic oligonucleotide
cattacaacttgcaggaaaa

SEQ ID NO: 6482 - DNA, 20 bp, Artificial Sequence
  Description of Artificial Sequence: Synthetic oligonucleotide
attacaacttgcaggaaaac

SEQ ID NO: 6483 - DNA, 20 bp, Artificial Sequence
  Description of Artificial Sequence: Synthetic oligonucleotide
ttacaacttgcaggaaaacc

SEQ ID NO: 6484 - DNA, 20 bp, Artificial Sequence
  Description of Artificial Sequence: Synthetic oligonucleotide
tacaacttgcaggaaaacca

SEQ ID NO: 6485 - DNA, 20 bp, Artificial Sequence
  Description of Artificial Sequence: Synthetic oligonucleotide
acaacttgcaggaaaaccat

SEQ ID NO: 6486 - DNA, 20 bp, Artificial Sequence
  Description of Artificial Sequence: Synthetic oligonucleotide
caacttgcaggaaaaccatc

SEQ ID NO: 6487 - DNA, 20 bp, Artificial Sequence
  Description of Artificial Sequence: Synthetic oligonucleotide
aacttgcaggaaaaccatca

SEQ ID NO: 6488 - DNA, 20 bp, Artificial Sequence
  Description of Artificial Sequence: Synthetic oligonucleotide
acttgcaggaaaaccatcac

SEQ ID NO: 6489 - DNA, 20 bp, Artificial Sequence
  Description of Artificial Sequence: Synthetic oligonucleotide
cttgcaggaaaaccatcaca

SEQ ID NO: 6490 - DNA, 20 bp, Artificial Sequence
  Description of Artificial Sequence: Synthetic oligonucleotide
ttgcaggaaaaccatcacaa

SEQ ID NO: 6491 - DNA, 20 bp, Artificial Sequence
  Description of Artificial Sequence: Synthetic oligonucleotide
tgcaggaaaaccatcacaat

SEQ ID NO: 6492 - DNA, 20 bp, Artificial Sequence
  Description of Artificial Sequence: Synthetic oligonucleotide
gcaggaaaaccatcacaatg

SEQ ID NO: 6493 - DNA, 20 bp, Artificial Sequence
  Description of Artificial Sequence: Synthetic oligonucleotide
caggaaaaccatcacaatga

SEQ ID NO: 6494 - DNA, 20 bp, Artificial Sequence
  Description of Artificial Sequence: Synthetic oligonucleotide
aggaaaaccatcacaatgaa

SEQ ID NO: 6495 - DNA, 20 bp, Artificial Sequence
  Description of Artificial Sequence: Synthetic oligonucleotide
ggaaaaccatcacaatgaat

SEQ ID NO: 6496 - DNA, 20 bp, Artificial Sequence
  Description of Artificial Sequence: Synthetic oligonucleotide
gaaaaccatcacaatgaata

SEQ ID NO: 6497 - DNA, 20 bp, Artificial Sequence
  Description of Artificial Sequence: Synthetic oligonucleotide
aaaaccatcacaatgaatat

SEQ ID NO: 6498 - DNA, 20 bp, Artificial Sequence
  Description of Artificial Sequence: Synthetic oligonucleotide
aaaccatcacaatgaatata

SEQ ID NO: 6499 - DNA, 20 bp, Artificial Sequence
  Description of Artificial Sequence: Synthetic oligonucleotide
aaccatcacaatgaatatac

SEQ ID NO: 6500 - DNA, 20 bp, Artificial Sequence
  Description of Artificial Sequence: Synthetic oligonucleotide
accatcacaatgaatataca

SEQ ID NO: 6501 - DNA, 20 bp, Artificial Sequence
  Description of Artificial Sequence: Synthetic oligonucleotide
ccatcacaatgaatatacag

SEQ ID NO: 6502 - DNA, 20 bp, Artificial Sequence
  Description of Artificial Sequence: Synthetic oligonucleotide
catcacaatgaatatacaga

SEQ ID NO: 6503 - DNA, 20 bp, Artificial Sequence
  Description of Artificial Sequence: Synthetic oligonucleotide
atcacaatgaatatacagat

SEQ ID NO: 6504 - DNA, 20 bp, Artificial Sequence
  Description of Artificial Sequence: Synthetic oligonucleotide
tcacaatgaatatacagatt

SEQ ID NO: 6505 - DNA, 20 bp, Artificial Sequence
  Description of Artificial Sequence: Synthetic oligonucleotide
cacaatgaatatacagattt

SEQ ID NO: 6506 - DNA, 20 bp, Artificial Sequence
  Description of Artificial Sequence: Synthetic oligonucleotide
acaatgaatatacagatttg

SEQ ID NO: 6507 - DNA, 20 bp, Artificial Sequence
  Description of Artificial Sequence: Synthetic oligonucleotide
caatgaatatacagatttgt

SEQ ID NO: 6508 - DNA, 20 bp, Artificial Sequence
  Description of Artificial Sequence: Synthetic oligonucleotide
aatgaatatacagatttgtc

SEQ ID NO: 6509 - DNA, 20 bp, Artificial Sequence
  Description of Artificial Sequence: Synthetic oligonucleotide
atgaatatacagatttgtct

SEQ ID NO: 6510 - DNA, 20 bp, Artificial Sequence
  Description of Artificial Sequence: Synthetic oligonucleotide
tgaatatacagatttgtctt

SEQ ID NO: 6511 - DNA, 20 bp, Artificial Sequence
  Description of Artificial Sequence: Synthetic oligonucleotide
gaatatacagatttgtcttg

SEQ ID NO: 6512 - DNA, 20 bp, Artificial Sequence
  Description of Artificial Sequence: Synthetic oligonucleotide
aatatacagatttgtcttga

SEQ ID NO: 6513 - DNA, 20 bp, Artificial Sequence
  Description of Artificial Sequence: Synthetic oligonucleotide
atatacagatttgtcttgaa

SEQ ID NO: 6514 - DNA, 20 bp, Artificial Sequence
  Description of Artificial Sequence: Synthetic oligonucleotide
tatacagatttgtcttgaat

SEQ ID NO: 6515 - DNA, 20 bp, Artificial Sequence
  Description of Artificial Sequence: Synthetic oligonucleotide
atacagatttgtcttgaatc

SEQ ID NO: 6516 - DNA, 20 bp, Artificial Sequence
  Description of Artificial Sequence: Synthetic oligonucleotide
tacagatttgtcttgaatca

SEQ ID NO: 6517 - DNA, 20 bp, Artificial Sequence
  Description of Artificial Sequence: Synthetic oligonucleotide
acagatttgtcttgaatcag

SEQ ID NO: 6518 - DNA, 20 bp, Artificial Sequence
  Description of Artificial Sequence: Synthetic oligonucleotide
cagatttgtcttgaatcaga

SEQ ID NO: 6519 - DNA, 20 bp, Artificial Sequence
  Description of Artificial Sequence: Synthetic oligonucleotide
agatttgtcttgaatcagaa

SEQ ID NO: 6520 - DNA, 20 bp, Artificial Sequence
  Description of Artificial Sequence: Synthetic oligonucleotide
gatttgtcttgaatcagaat

SEQ ID NO: 6521 - DNA, 20 bp, Artificial Sequence
  Description of Artificial Sequence: Synthetic oligonucleotide
atttgtcttgaatcagaata

SEQ ID NO: 6522 - DNA, 20 bp, Artificial Sequence
  Description of Artificial Sequence: Synthetic oligonucleotide
tttgtcttgaatcagaatag

SEQ ID NO: 6523 - DNA, 20 bp, Artificial Sequence
  Description of Artificial Sequence: Synthetic oligonucleotide
ttgtcttgaatcagaatagg

SEQ ID NO: 6524 - DNA, 20 bp, Artificial Sequence
  Description of Artificial Sequence: Synthetic oligonucleotide
tgtcttgaatcagaatagga

SEQ ID NO: 6525 - DNA, 20 bp, Artificial Sequence
  Description of Artificial Sequence: Synthetic oligonucleotide
gtcttgaatcagaataggaa

SEQ ID NO: 6526 - DNA, 20 bp, Artificial Sequence
  Description of Artificial Sequence: Synthetic oligonucleotide
tcttgaatcagaataggaat

SEQ ID NO: 6527 - DNA, 20 bp, Artificial Sequence
  Description of Artificial Sequence: Synthetic oligonucleotide
cttgaatcagaataggaatg

SEQ ID NO: 6528 - DNA, 20 bp, Artificial Sequence
  Description of Artificial Sequence: Synthetic oligonucleotide
ttgaatcagaataggaatgg

SEQ ID NO: 6529 - DNA, 20 bp, Artificial Sequence
  Description of Artificial Sequence: Synthetic oligonucleotide
tgaatcagaataggaatggc

SEQ ID NO: 6530 - DNA, 20 bp, Artificial Sequence
  Description of Artificial Sequence: Synthetic oligonucleotide
gaatcagaataggaatggca

SEQ ID NO: 6531 - DNA, 20 bp, Artificial Sequence
  Description of Artificial Sequence: Synthetic oligonucleotide
aatcagaataggaatggcac

SEQ ID NO: 6532 - DNA, 20 bp, Artificial Sequence
  Description of Artificial Sequence: Synthetic oligonucleotide
atcagaataggaatggcacc

SEQ ID NO: 6533 - DNA, 20 bp, Artificial Sequence
  Description of Artificial Sequence: Synthetic oligonucleotide
tcagaataggaatggcaccc

SEQ ID NO: 6534 - DNA, 20 bp, Artificial Sequence
  Description of Artificial Sequence: Synthetic oligonucleotide
cagaataggaatggcacccc

SEQ ID NO: 6535 - DNA, 20 bp, Artificial Sequence
  Description of Artificial Sequence: Synthetic oligonucleotide
agaataggaatggcaccccc

SEQ ID NO: 6536 - DNA, 20 bp, Artificial Sequence
  Description of Artificial Sequence: Synthetic oligonucleotide
gaataggaatggcacccccg

SEQ ID NO: 6537 - DNA, 20 bp, Artificial Sequence
  Description of Artificial Sequence: Synthetic oligonucleotide
aataggaatggcacccccgg

SEQ ID NO: 6538 - DNA, 20 bp, Artificial Sequence
  Description of Artificial Sequence: Synthetic oligonucleotide
ataggaatggcacccccgga

SEQ ID NO: 6539 - DNA, 20 bp, Artificial Sequence
  Description of Artificial Sequence: Synthetic oligonucleotide
taggaatggcacccccggag

SEQ ID NO: 6540 - DNA, 20 bp, Artificial Sequence
  Description of Artificial Sequence: Synthetic oligonucleotide
aggaatggcacccccggagt

SEQ ID NO: 6541 - DNA, 20 bp, Artificial Sequence
  Description of Artificial Sequence: Synthetic oligonucleotide
ggaatggcacccccggagtt

SEQ ID NO: 6542 - DNA, 20 bp, Artificial Sequence
  Description of Artificial Sequence: Synthetic oligonucleotide
gaatggcacccccggagttg

SEQ ID NO: 6543 - DNA, 20 bp, Artificial Sequence
  Description of Artificial Sequence: Synthetic oligonucleotide
aatggcacccccggagttgt

SEQ ID NO: 6544 - DNA, 20 bp, Artificial Sequence
  Description of Artificial Sequence: Synthetic oligonucleotide
atggcacccccggagttgta

SEQ ID NO: 6545 - DNA, 20 bp, Artificial Sequence
  Description of Artificial Sequence: Synthetic oligonucleotide
tggcacccccggagttgtac

SEQ ID NO: 6546 - DNA, 20 bp, Artificial Sequence
  Description of Artificial Sequence: Synthetic oligonucleotide
ggcacccccggagttgtacg

SEQ ID NO: 6547 - DNA, 20 bp, Artificial Sequence
  Description of Artificial Sequence: Synthetic oligonucleotide
gcacccccggagttgtacgc

SEQ ID NO: 6548 - DNA, 20 bp, Artificial Sequence
  Description of Artificial Sequence: Synthetic oligonucleotide
cacccccggagttgtacgcg

SEQ ID NO: 6549 - DNA, 20 bp, Artificial Sequence
  Description of Artificial Sequence: Synthetic oligonucleotide
acccccggagttgtacgcgg

SEQ ID NO: 6550 - DNA, 20 bp, Artificial Sequence
  Description of Artificial Sequence: Synthetic oligonucleotide
cccccggagttgtacgcggt

SEQ ID NO: 6551 - DNA, 20 bp, Artificial Sequence
  Description of Artificial Sequence: Synthetic oligonucleotide
ccccggagttgtacgcggtc

SEQ ID NO: 6552 - DNA, 20 bp, Artificial Sequence
  Description of Artificial Sequence: Synthetic oligonucleotide
cccggagttgtacgcggtca

SEQ ID NO: 6553 - DNA, 20 bp, Artificial Sequence
  Description of Artificial Sequence: Synthetic oligonucleotide
ccggagttgtacgcggtcat

SEQ ID NO: 6554 - DNA, 20 bp, Artificial Sequence
  Description of Artificial Sequence: Synthetic oligonucleotide
cggagttgtacgcggtcatg

SEQ ID NO: 6555 - DNA, 20 bp, Artificial Sequence
  Description of Artificial Sequence: Synthetic oligonucleotide
ggagttgtacgcggtcatgt

SEQ ID NO: 6556 - DNA, 20 bp, Artificial Sequence
  Description of Artificial Sequence: Synthetic oligonucleotide
gagttgtacgcggtcatgtg

SEQ ID NO: 6557 - DNA, 20 bp, Artificial Sequence
  Description of Artificial Sequence: Synthetic oligonucleotide
agttgtacgcggtcatgtgt

SEQ ID NO: 6558 - DNA, 20 bp, Artificial Sequence
  Description of Artificial Sequence: Synthetic oligonucleotide
gttgtacgcggtcatgtgtg

SEQ ID NO: 6559 - DNA, 20 bp, Artificial Sequence
  Description of Artificial Sequence: Synthetic oligonucleotide
ttgtacgcggtcatgtgtgg

SEQ ID NO: 6560 - DNA, 20 bp, Artificial Sequence
  Description of Artificial Sequence: Synthetic oligonucleotide
tgtacgcggtcatgtgtggt

SEQ ID NO: 6561 - DNA, 20 bp, Artificial Sequence
  Description of Artificial Sequence: Synthetic oligonucleotide
gtacgcggtcatgtgtggtg

SEQ ID NO: 6562 - DNA, 20 bp, Artificial Sequence
  Description of Artificial Sequence: Synthetic oligonucleotide
tacgcggtcatgtgtggtgg

SEQ ID NO: 6563 - DNA, 20 bp, Artificial Sequence
  Description of Artificial Sequence: Synthetic oligonucleotide
acgcggtcatgtgtggtggc

SEQ ID NO: 6564 - DNA, 20 bp, Artificial Sequence
  Description of Artificial Sequence: Synthetic oligonucleotide
cgcggtcatgtgtggtggca

SEQ ID NO: 6565 - DNA, 20 bp, Artificial Sequence
  Description of Artificial Sequence: Synthetic oligonucleotide
gcggtcatgtgtggtggcac

SEQ ID NO: 6566 - DNA, 20 bp, Artificial Sequence
  Description of Artificial Sequence: Synthetic oligonucleotide
cggtcatgtgtggtggcact

SEQ ID NO: 6567 - DNA, 20 bp, Artificial Sequence
  Description of Artificial Sequence: Synthetic oligonucleotide
ggtcatgtgtggtggcactg

SEQ ID NO: 6568 - DNA, 20 bp, Artificial Sequence
  Description of Artificial Sequence: Synthetic oligonucleotide
gtcatgtgtggtggcactgg

SEQ ID NO: 6569 - DNA, 20 bp, Artificial Sequence
  Description of Artificial Sequence: Synthetic oligonucleotide
tcatgtgtggtggcactggt

SEQ ID NO: 6570 - DNA, 20 bp, Artificial Sequence
  Description of Artificial Sequence: Synthetic oligonucleotide
catgtgtggtggcactggtc

SEQ ID NO: 6571 - DNA, 20 bp, Artificial Sequence
  Description of Artificial Sequence: Synthetic oligonucleotide
atgtgtggtggcactggtcc

SEQ ID NO: 6572 - DNA, 20 bp, Artificial Sequence
  Description of Artificial Sequence: Synthetic oligonucleotide
tgtgtggtggcactggtcca

SEQ ID NO: 6573 - DNA, 20 bp, Artificial Sequence
  Description of Artificial Sequence: Synthetic oligonucleotide
gtgtggtggcactggtccag

SEQ ID NO: 6574 - DNA, 20 bp, Artificial Sequence
  Description of Artificial Sequence: Synthetic oligonucleotide
tgtggtggcactggtccagt

SEQ ID NO: 6575 - DNA, 20 bp, Artificial Sequence
  Description of Artificial Sequence: Synthetic oligonucleotide
gtggtggcactggtccagtc

SEQ ID NO: 6576 - DNA, 20 bp, Artificial Sequence
  Description of Artificial Sequence: Synthetic oligonucleotide
tggtggcactggtccagtca

SEQ ID NO: 6577 - DNA, 20 bp, Artificial Sequence
  Description of Artificial Sequence: Synthetic oligonucleotide
ggtggcactggtccagtcat

SEQ ID NO: 6578 - DNA, 20 bp, Artificial Sequence
  Description of Artificial Sequence: Synthetic oligonucleotide
gtggcactggtccagtcatg

SEQ ID NO: 6579 - DNA, 20 bp, Artificial Sequence
  Description of Artificial Sequence: Synthetic oligonucleotide
tggcactggtccagtcatgg

SEQ ID NO: 6580 - DNA, 20 bp, Artificial Sequence
  Description of Artificial Sequence: Synthetic oligonucleotide
ggcactggtccagtcatggg

SEQ ID NO: 6581 - DNA, 20 bp, Artificial Sequence
  Description of Artificial Sequence: Synthetic oligonucleotide
gcactggtccagtcatgggg

SEQ ID NO: 6582 - DNA, 20 bp, Artificial Sequence
  Description of Artificial Sequence: Synthetic oligonucleotide
cactggtccagtcatggggc

SEQ ID NO: 6583 - DNA, 20 bp, Artificial Sequence
  Description of Artificial Sequence: Synthetic oligonucleotide
actggtccagtcatggggcc

SEQ ID NO: 6584 - DNA, 20 bp, Artificial Sequence
  Description of Artificial Sequence: Synthetic oligonucleotide
ctggtccagtcatggggccc

SEQ ID NO: 6585 - DNA, 20 bp, Artificial Sequence
  Description of Artificial Sequence: Synthetic oligonucleotide
tggtccagtcatggggcccc

SEQ ID NO: 6586 - DNA, 20 bp, Artificial Sequence
  Description of Artificial Sequence: Synthetic oligonucleotide
ggtccagtcatggggcccct

SEQ ID NO: 6587 - DNA, 20 bp, Artificial Sequence
  Description of Artificial Sequence: Synthetic oligonucleotide
gtccagtcatggggcccctg

SEQ ID NO: 6588 - DNA, 20 bp, Artificial Sequence
  Description of Artificial Sequence: Synthetic oligonucleotide
tccagtcatggggcccctgg

SEQ ID NO: 6589 - DNA, 20 bp, Artificial Sequence
  Description of Artificial Sequence: Synthetic oligonucleotide
ccagtcatggggcccctggc

SEQ ID NO: 6590 - DNA, 20 bp, Artificial Sequence
  Description of Artificial Sequence: Synthetic oligonucleotide
cagtcatggggcccctggcc

SEQ ID NO: 6591 - DNA, 20 bp, Artificial Sequence
  Description of Artificial Sequence: Synthetic oligonucleotide
agtcatggggcccctggcct

SEQ ID NO: 6592 - DNA, 20 bp, Artificial Sequence
  Description of Artificial Sequence: Synthetic oligonucleotide
gtcatggggcccctggcctt

SEQ ID NO: 6593 - DNA, 20 bp, Artificial Sequence
  Description of Artificial Sequence: Synthetic oligonucleotide
tcatggggcccctggccttg

SEQ ID NO: 6594 - DNA, 20 bp, Artificial Sequence
  Description of Artificial Sequence: Synthetic oligonucleotide
catggggcccctggccttgt

SEQ ID NO: 6595 - DNA, 20 bp, Artificial Sequence
  Description of Artificial Sequence: Synthetic oligonucleotide
atggggcccctggccttgtg

SEQ ID NO: 6596 - DNA, 20 bp, Artificial Sequence
  Description of Artificial Sequence: Synthetic oligonucleotide
tggggcccctggccttgtgc

SEQ ID NO: 6597 - DNA, 20 bp, Artificial Sequence
  Description of Artificial Sequence: Synthetic oligonucleotide
ggggcccctggccttgtgct

SEQ ID NO: 6598 - DNA, 20 bp, Artificial Sequence
  Description of Artificial Sequence: Synthetic oligonucleotide
gggcccctggccttgtgctt

SEQ ID NO: 6599 - DNA, 20 bp, Artificial Sequence
  Description of Artificial Sequence: Synthetic oligonucleotide
ggcccctggccttgtgctta

SEQ ID NO: 6600 - DNA, 20 bp, Artificial Sequence
  Description of Artificial Sequence: Synthetic oligonucleotide
gcccctggccttgtgcttac

SEQ ID NO: 6601 - DNA, 20 bp, Artificial Sequence
  Description of Artificial Sequence: Synthetic oligonucleotide
cccctggccttgtgcttacc

SEQ ID NO: 6602 - DNA, 20 bp, Artificial Sequence
  Description of Artificial Sequence: Synthetic oligonucleotide
ccctggccttgtgcttacct

SEQ ID NO: 6603 - DNA, 20 bp, Artificial Sequence
  Description of Artificial Sequence: Synthetic oligonucleotide
cctggccttgtgcttacctc

SEQ ID NO: 6604 - DNA, 20 bp, Artificial Sequence
  Description of Artificial Sequence: Synthetic oligonucleotide
ctggccttgtgcttacctcc

SEQ ID NO: 6605 - DNA, 20 bp, Artificial Sequence
  Description of Artificial Sequence: Synthetic oligonucleotide
tggccttgtgcttacctcca

SEQ ID NO: 6606 - DNA, 20 bp, Artificial Sequence
  Description of Artificial Sequence: Synthetic oligonucleotide
ggccttgtgcttacctccat

SEQ ID NO: 6607 - DNA, 20 bp, Artificial Sequence
  Description of Artificial Sequence: Synthetic oligonucleotide
gccttgtgcttacctccatc

SEQ ID NO: 6608 - DNA, 20 bp, Artificial Sequence
  Description of Artificial Sequence: Synthetic oligonucleotide
ccttgtgcttacctccatct

SEQ ID NO: 6609 - DNA, 20 bp, Artificial Sequence
  Description of Artificial Sequence: Synthetic oligonucleotide
cttgtgcttacctccatctc

SEQ ID NO: 6610 - DNA, 20 bp, Artificial Sequence
  Description of Artificial Sequence: Synthetic oligonucleotide
ttgtgcttacctccatctct

SEQ ID NO: 6611 - DNA, 20 bp, Artificial Sequence
  Description of Artificial Sequence: Synthetic oligonucleotide
tgtgcttacctccatctcta

SEQ ID NO: 6612 - DNA, 20 bp, Artificial Sequence
  Description of Artificial Sequence: Synthetic oligonucleotide
gtgcttacctccatctctac

SEQ ID NO: 6613 - DNA, 20 bp, Artificial Sequence
  Description of Artificial Sequence: Synthetic oligonucleotide
tgcttacctccatctctaca

SEQ ID NO: 6614 - DNA, 20 bp, Artificial Sequence
  Description of Artificial Sequence: Synthetic oligonucleotide
gcttacctccatctctacac

SEQ ID NO: 6615 - DNA, 20 bp, Artificial Sequence
  Description of Artificial Sequence: Synthetic oligonucleotide
cttacctccatctctacacg

SEQ ID NO: 6616 - DNA, 20 bp, Artificial Sequence
  Description of Artificial Sequence: Synthetic oligonucleotide
ttacctccatctctacacgc

SEQ ID NO: 6617 - DNA, 20 bp, Artificial Sequence
  Description of Artificial Sequence: Synthetic oligonucleotide
tacctccatctctacacgca

SEQ ID NO: 6618 - DNA, 20 bp, Artificial Sequence
  Description of Artificial Sequence: Synthetic oligonucleotide
acctccatctctacacgcag

SEQ ID NO: 6619 - DNA, 20 bp, Artificial Sequence
  Description of Artificial Sequence: Synthetic oligonucleotide
cctccatctctacacgcagc

SEQ ID NO: 6620 - DNA, 20 bp, Artificial Sequence
  Description of Artificial Sequence: Synthetic oligonucleotide
ctccatctctacacgcagcc

SEQ ID NO: 6621 - DNA, 20 bp, Artificial Sequence
  Description of Artificial Sequence: Synthetic oligonucleotide
tccatctctacacgcagccg

SEQ ID NO: 6622 - DNA, 20 bp, Artificial Sequence
  Description of Artificial Sequence: Synthetic oligonucleotide
ccatctctacacgcagccgg

SEQ ID NO: 6623 - DNA, 20 bp, Artificial Sequence
  Description of Artificial Sequence: Synthetic oligonucleotide
catctctacacgcagccggg

SEQ ID NO: 6624 - DNA, 20 bp, Artificial Sequence
  Description of Artificial Sequence: Synthetic oligonucleotide
atctctacacgcagccgggt

SEQ ID NO: 6625 - DNA, 20 bp, Artificial Sequence
  Description of Artificial Sequence: Synthetic oligonucleotide
tctctacacgcagccgggtt

SEQ ID NO: 6626 - DNA, 20 bp, Artificial Sequence
  Description of Artificial Sequence: Synthetic oligonucleotide
ctctacacgcagccgggttg

SEQ ID NO: 6627 - DNA, 20 bp, Artificial Sequence
  Description of Artificial Sequence: Synthetic oligonucleotide
tctacacgcagccgggttgg

SEQ ID NO: 6628 - DNA, 20 bp, Artificial Sequence
  Description of Artificial Sequence: Synthetic oligonucleotide
ctacacgcagccgggttggc

SEQ ID NO: 6629 - DNA, 20 bp, Artificial Sequence
  Description of Artificial Sequence: Synthetic oligonucleotide
tacacgcagccgggttggct

SEQ ID NO: 6630 - DNA, 20 bp, Artificial Sequence
  Description of Artificial Sequence: Synthetic oligonucleotide
acacgcagccgggttggctg

SEQ ID NO: 6631 - DNA, 20 bp, Artificial Sequence
  Description of Artificial Sequence: Synthetic oligonucleotide
cacgcagccgggttggctgt

SEQ ID NO: 6632 - DNA, 20 bp, Artificial Sequence
  Description of Artificial Sequence: Synthetic oligonucleotide
acgcagccgggttggctgtc

SEQ ID NO: 6633 - DNA, 20 bp, Artificial Sequence
  Description of Artificial Sequence: Synthetic oligonucleotide
cgcagccgggttggctgtct

SEQ ID NO: 6634 - DNA, 20 bp, Artificial Sequence
  Description of Artificial Sequence: Synthetic oligonucleotide
gcagccgggttggctgtctg

SEQ ID NO: 6635 - DNA, 20 bp, Artificial Sequence
  Description of Artificial Sequence: Synthetic oligonucleotide
cagccgggttggctgtctgg

SEQ ID NO: 6636 - DNA, 20 bp, Artificial Sequence
  Description of Artificial Sequence: Synthetic oligonucleotide
agccgggttggctgtctgga

SEQ ID NO: 6637 - DNA, 20 bp, Artificial Sequence
  Description of Artificial Sequence: Synthetic oligonucleotide
gccgggttggctgtctggag

SEQ ID NO: 6638 - DNA, 20 bp, Artificial Sequence
  Description of Artificial Sequence: Synthetic oligonucleotide
ccgggttggctgtctggaga

SEQ ID NO: 6639 - DNA, 20 bp, Artificial Sequence
  Description of Artificial Sequence: Synthetic oligonucleotide
cgggttggctgtctggagag

SEQ ID NO: 6640 - DNA, 20 bp, Artificial Sequence
  Description of Artificial Sequence: Synthetic oligonucleotide
gggttggctgtctggagagc

SEQ ID NO: 6641 - DNA, 20 bp, Artificial Sequence
  Description of Artificial Sequence: Synthetic oligonucleotide
ggttggctgtctggagagcc

SEQ ID NO: 6642 - DNA, 20 bp, Artificial Sequence
  Description of Artificial Sequence: Synthetic oligonucleotide
gttggctgtctggagagccg

SEQ ID NO: 6643 - DNA, 20 bp, Artificial Sequence
  Description of Artificial Sequence: Synthetic oligonucleotide
ttggctgtctggagagccgg

SEQ ID NO: 6644 - DNA, 20 bp, Artificial Sequence
  Description of Artificial Sequence: Synthetic oligonucleotide
tggctgtctggagagccggt

SEQ ID NO: 6645 - DNA, 20 bp, Artificial Sequence
  Description of Artificial Sequence: Synthetic oligonucleotide
ggctgtctggagagccggtg

SEQ ID NO: 6646 - DNA, 20 bp, Artificial Sequence
  Description of Artificial Sequence: Synthetic oligonucleotide
gctgtctggagagccggtgg

SEQ ID NO: 6647 - DNA, 20 bp, Artificial Sequence
  Description of Artificial Sequence: Synthetic oligonucleotide
ctgtctggagagccggtgga

SEQ ID NO: 6648 - DNA, 20 bp, Artificial Sequence
  Description of Artificial Sequence: Synthetic oligonucleotide
tgtctggagagccggtggat

SEQ ID NO: 6649 - DNA, 20 bp, Artificial Sequence
  Description of Artificial Sequence: Synthetic oligonucleotide
gtctggagagccggtggatg

SEQ ID NO: 6650 - DNA, 20 bp, Artificial Sequence
  Description of Artificial Sequence: Synthetic oligonucleotide
tctggagagccggtggatgt

SEQ ID NO: 6651 - DNA, 20 bp, Artificial Sequence
  Description of Artificial Sequence: Synthetic oligonucleotide
ctggagagccggtggatgtg

SEQ ID NO: 6652 - DNA, 20 bp, Artificial Sequence
  Description of Artificial Sequence: Synthetic oligonucleotide
tggagagccggtggatgtgt

SEQ ID NO: 6653 - DNA, 20 bp, Artificial Sequence
  Description of Artificial Sequence: Synthetic oligonucleotide
ggagagccggtggatgtgtt

SEQ ID NO: 6654 - DNA, 20 bp, Artificial Sequence
  Description of Artificial Sequence: Synthetic oligonucleotide
gagagccggtggatgtgttc

SEQ ID NO: 6655 - DNA, 20 bp, Artificial Sequence
  Description of Artificial Sequence: Synthetic oligonucleotide
agagccggtggatgtgttcg

SEQ ID NO: 6656 - DNA, 20 bp, Artificial Sequence
  Description of Artificial Sequence: Synthetic oligonucleotide
gagccggtggatgtgttcgt

SEQ ID NO: 6657 - DNA, 20 bp, Artificial Sequence
  Description of Artificial Sequence: Synthetic oligonucleotide
agccggtggatgtgttcgtt

SEQ ID NO: 6658 - DNA, 20 bp, Artificial Sequence
  Description of Artificial Sequence: Synthetic oligonucleotide
gccggtggatgtgttcgttc

SEQ ID NO: 6659 - DNA, 20 bp, Artificial Sequence
  Description of Artificial Sequence: Synthetic oligonucleotide
ccggtggatgtgttcgttcc

SEQ ID NO: 6660 - DNA, 20 bp, Artificial Sequence
  Description of Artificial Sequence: Synthetic oligonucleotide
cggtggatgtgttcgttccc

SEQ ID NO: 6661 - DNA, 20 bp, Artificial Sequence
  Description of Artificial Sequence: Synthetic oligonucleotide
ggtggatgtgttcgttcccc

SEQ ID NO: 6662 - DNA, 20 bp, Artificial Sequence
  Description of Artificial Sequence: Synthetic oligonucleotide
gtggatgtgttcgttcccca

SEQ ID NO: 6663 - DNA, 20 bp, Artificial Sequence
  Description of Artificial Sequence: Synthetic oligonucleotide
tggatgtgttcgttccccag

SEQ ID NO: 6664 - DNA, 20 bp, Artificial Sequence
  Description of Artificial Sequence: Synthetic oligonucleotide
ggatgtgttcgttccccagc

SEQ ID NO: 6665 - DNA, 20 bp, Artificial Sequence
  Description of Artificial Sequence: Synthetic oligonucleotide
gatgtgttcgttccccagcc

SEQ ID NO: 6666 - DNA, 20 bp, Artificial Sequence
  Description of Artificial Sequence: Synthetic oligonucleotide
atgtgttcgttccccagcca

SEQ ID NO: 6667 - DNA, 20 bp, Artificial Sequence
  Description of Artificial Sequence: Synthetic oligonucleotide
tgtgttcgttccccagccag

SEQ ID NO: 6668 - DNA, 20 bp, Artificial Sequence
  Description of Artificial Sequence: Synthetic oligonucleotide
gtgttcgttccccagccaga

SEQ ID NO: 6669 - DNA, 20 bp, Artificial Sequence
  Description of Artificial Sequence: Synthetic oligonucleotide
tgttcgttccccagccagaa

SEQ ID NO: 6670 - DNA, 20 bp, Artificial Sequence
  Description of Artificial Sequence: Synthetic oligonucleotide
gttcgttccccagccagaag

SEQ ID NO: 6671 - DNA, 20 bp, Artificial Sequence
  Description of Artificial Sequence: Synthetic oligonucleotide
ttcgttccccagccagaagt

SEQ ID NO: 6672 - DNA, 20 bp, Artificial Sequence
  Description of Artificial Sequence: Synthetic oligonucleotide
tcgttccccagccagaagtc

SEQ ID NO: 6673 - DNA, 20 bp, Artificial Sequence
  Description of Artificial Sequence: Synthetic oligonucleotide
cgttccccagccagaagtcc

SEQ ID NO: 6674 - DNA, 20 bp, Artificial Sequence
  Description of Artificial Sequence: Synthetic oligonucleotide
gttccccagccagaagtccc

SEQ ID NO: 6675 - DNA, 20 bp, Artificial Sequence
  Description of Artificial Sequence: Synthetic oligonucleotide
ttccccagccagaagtcccc

SEQ ID NO: 6676 - DNA, 20 bp, Artificial Sequence
  Description of Artificial Sequence: Synthetic oligonucleotide
tccccagccagaagtcccca

SEQ ID NO: 6677 - DNA, 20 bp, Artificial Sequence
  Description of Artificial Sequence: Synthetic oligonucleotide
ccccagccagaagtccccac

SEQ ID NO: 6678 - DNA, 20 bp, Artificial Sequence
  Description of Artificial Sequence: Synthetic oligonucleotide
cccagccagaagtccccacg

SEQ ID NO: 6679 - DNA, 20 bp, Artificial Sequence
  Description of Artificial Sequence: Synthetic oligonucleotide
ccagccagaagtccccacgg

SEQ ID NO: 6680 - DNA, 20 bp, Artificial Sequence
  Description of Artificial Sequence: Synthetic oligonucleotide
cagccagaagtccccacgga

SEQ ID NO: 6681 - DNA, 20 bp, Artificial Sequence
  Description of Artificial Sequence: Synthetic oligonucleotide
agccagaagtccccacggat

SEQ ID NO: 6682 - DNA, 20 bp, Artificial Sequence
  Description of Artificial Sequence: Synthetic oligonucleotide
gccagaagtccccacggatg

SEQ ID NO: 6683 - DNA, 20 bp, Artificial Sequence
  Description of Artificial Sequence: Synthetic oligonucleotide
ccagaagtccccacggatgc

SEQ ID NO: 6684 - DNA, 20 bp, Artificial Sequence
  Description of Artificial Sequence: Synthetic oligonucleotide
cagaagtccccacggatgct

SEQ ID NO: 6685 - DNA, 20 bp, Artificial Sequence
  Description of Artificial Sequence: Synthetic oligonucleotide
agaagtccccacggatgctg

SEQ ID NO: 6686 - DNA, 20 bp, Artificial Sequence
  Description of Artificial Sequence: Synthetic oligonucleotide
gaagtccccacggatgctgc

SEQ ID NO: 6687 - DNA, 20 bp, Artificial Sequence
  Description of Artificial Sequence: Synthetic oligonucleotide
aagtccccacggatgctgcc

SEQ ID NO: 6688 - DNA, 20 bp, Artificial Sequence
  Description of Artificial Sequence: Synthetic oligonucleotide
agtccccacggatgctgcca

SEQ ID NO: 6689 - DNA, 20 bp, Artificial Sequence
  Description of Artificial Sequence: Synthetic oligonucleotide
gtccccacggatgctgccaa

SEQ ID NO: 6690 - DNA, 20 bp, Artificial Sequence
  Description of Artificial Sequence: Synthetic oligonucleotide
tccccacggatgctgccaaa

SEQ ID NO: 6691 - DNA, 20 bp, Artificial Sequence
  Description of Artificial Sequence: Synthetic oligonucleotide
ccccacggatgctgccaaag

SEQ ID NO: 6692 - DNA, 20 bp, Artificial Sequence
  Description of Artificial Sequence: Synthetic oligonucleotide
cccacggatgctgccaaagc

SEQ ID NO: 6693 - DNA, 20 bp, Artificial Sequence
  Description of Artificial Sequence: Synthetic oligonucleotide
ccacggatgctgccaaagcc

SEQ ID NO: 6694 - DNA, 20 bp, Artificial Sequence
  Description of Artificial Sequence: Synthetic oligonucleotide
cacggatgctgccaaagccc

SEQ ID NO: 6695 - DNA, 20 bp, Artificial Sequence
  Description of Artificial Sequence: Synthetic oligonucleotide
acggatgctgccaaagccct

SEQ ID NO: 6696 - DNA, 20 bp, Artificial Sequence
  Description of Artificial Sequence: Synthetic oligonucleotide
cggatgctgccaaagccctg

SEQ ID NO: 6697 - DNA, 20 bp, Artificial Sequence
  Description of Artificial Sequence: Synthetic oligonucleotide
ggatgctgccaaagccctgc

SEQ ID NO: 6698 - DNA, 20 bp, Artificial Sequence
  Description of Artificial Sequence: Synthetic oligonucleotide
gatgctgccaaagccctgct

SEQ ID NO: 6699 - DNA, 20 bp, Artificial Sequence
  Description of Artificial Sequence: Synthetic oligonucleotide
atgctgccaaagccctgctt

SEQ ID NO: 6700 - DNA, 20 bp, Artificial Sequence
  Description of Artificial Sequence: Synthetic oligonucleotide
tgctgccaaagccctgcttg

SEQ ID NO: 6701 - DNA, 20 bp, Artificial Sequence
  Description of Artificial Sequence: Synthetic oligonucleotide
gctgccaaagccctgcttgt

SEQ ID NO: 6702 - DNA, 20 bp, Artificial Sequence
  Description of Artificial Sequence: Synthetic oligonucleotide
ctgccaaagccctgcttgta

SEQ ID NO: 6703 - DNA, 20 bp, Artificial Sequence
  Description of Artificial Sequence: Synthetic oligonucleotide
tgccaaagccctgcttgtac

SEQ ID NO: 6704 - DNA, 20 bp, Artificial Sequence
  Description of Artificial Sequence: Synthetic oligonucleotide
gccaaagccctgcttgtact

SEQ ID NO: 6705 - DNA, 20 bp, Artificial Sequence
  Description of Artificial Sequence: Synthetic oligonucleotide
ccaaagccctgcttgtactg

SEQ ID NO: 6706 - DNA, 20 bp, Artificial Sequence
  Description of Artificial Sequence: Synthetic oligonucleotide
caaagccctgcttgtactgc

SEQ ID NO: 6707 - DNA, 20 bp, Artificial Sequence
  Description of Artificial Sequence: Synthetic oligonucleotide
aaagccctgcttgtactgct

SEQ ID NO: 6708 - DNA, 20 bp, Artificial Sequence
  Description of Artificial Sequence: Synthetic oligonucleotide
aagccctgcttgtactgctt

SEQ ID NO: 6709 - DNA, 20 bp, Artificial Sequence
  Description of Artificial Sequence: Synthetic oligonucleotide
agccctgcttgtactgcttc

SEQ ID NO: 6710 - DNA, 20 bp, Artificial Sequence
  Description of Artificial Sequence: Synthetic oligonucleotide
gccctgcttgtactgcttcc

SEQ ID NO: 6711 - DNA, 20 bp, Artificial Sequence
  Description of Artificial Sequence: Synthetic oligonucleotide
ccctgcttgtactgcttcca

SEQ ID NO: 6712 - DNA, 20 bp, Artificial Sequence
  Description of Artificial Sequence: Synthetic oligonucleotide
cctgcttgtactgcttccag

SEQ ID NO: 6713 - DNA, 20 bp, Artificial Sequence
  Description of Artificial Sequence: Synthetic oligonucleotide
ctgcttgtactgcttccagt

SEQ ID NO: 6714 - DNA, 20 bp, Artificial Sequence
  Description of Artificial Sequence: Synthetic oligonucleotide
tgcttgtactgcttccagtc

SEQ ID NO: 6715 - DNA, 20 bp, Artificial Sequence
  Description of Artificial Sequence: Synthetic oligonucleotide
gcttgtactgcttccagtcc

SEQ ID NO: 6716 - DNA, 20 bp, Artificial Sequence
  Description of Artificial Sequence: Synthetic oligonucleotide
cttgtactgcttccagtccc

SEQ ID NO: 6717 - DNA, 20 bp, Artificial Sequence
  Description of Artificial Sequence: Synthetic oligonucleotide
ttgtactgcttccagtcccg

SEQ ID NO: 6718 - DNA, 20 bp, Artificial Sequence
  Description of Artificial Sequence: Synthetic oligonucleotide
tgtactgcttccagtcccgg

SEQ ID NO: 6719 - DNA, 20 bp, Artificial Sequence
  Description of Artificial Sequence: Synthetic oligonucleotide
gtactgcttccagtcccggt

SEQ ID NO: 6720 - DNA, 20 bp, Artificial Sequence
  Description of Artificial Sequence: Synthetic oligonucleotide
tactgcttccagtcccggta

SEQ ID NO: 6721 - DNA, 20 bp, Artificial Sequence
  Description of Artificial Sequence: Synthetic oligonucleotide
actgcttccagtcccggtag

SEQ ID NO: 6722 - DNA, 20 bp, Artificial Sequence
  Description of Artificial Sequence: Synthetic oligonucleotide
ctgcttccagtcccggtaga

SEQ ID NO: 6723 - DNA, 20 bp, Artificial Sequence
  Description of Artificial Sequence: Synthetic oligonucleotide
tgcttccagtcccggtagaa

SEQ ID NO: 6724 - DNA, 20 bp, Artificial Sequence
  Description of Artificial Sequence: Synthetic oligonucleotide
gcttccagtcccggtagaag

SEQ ID NO: 6725 - DNA, 20 bp, Artificial Sequence
  Description of Artificial Sequence: Synthetic oligonucleotide
cttccagtcccggtagaagg

SEQ ID NO: 6726 - DNA, 20 bp, Artificial Sequence
  Description of Artificial Sequence: Synthetic oligonucleotide
ttccagtcccggtagaagga

SEQ ID NO: 6727 - DNA, 20 bp, Artificial Sequence
  Description of Artificial Sequence: Synthetic oligonucleotide
tccagtcccggtagaaggag

SEQ ID NO: 6728 - DNA, 20 bp, Artificial Sequence
  Description of Artificial Sequence: Synthetic oligonucleotide
ccagtcccggtagaaggaga

SEQ ID NO: 6729 - DNA, 20 bp, Artificial Sequence
  Description of Artificial Sequence: Synthetic oligonucleotide
cagtcccggtagaaggagac

SEQ ID NO: 6730 - DNA, 20 bp, Artificial Sequence
  Description of Artificial Sequence: Synthetic oligonucleotide
agtcccggtagaaggagaca

SEQ ID NO: 6731 - DNA, 20 bp, Artificial Sequence
  Description of Artificial Sequence: Synthetic oligonucleotide
gtcccggtagaaggagacaa

SEQ ID NO: 6732 - DNA, 20 bp, Artificial Sequence
  Description of Artificial Sequence: Synthetic oligonucleotide
tcccggtagaaggagacaag

SEQ ID NO: 6733 - DNA, 20 bp, Artificial Sequence
  Description of Artificial Sequence: Synthetic oligonucleotide
cccggtagaaggagacaagg

SEQ ID NO: 6734 - DNA, 20 bp, Artificial Sequence
  Description of Artificial Sequence: Synthetic oligonucleotide
ccggtagaaggagacaaggc

SEQ ID NO: 6735 - DNA, 20 bp, Artificial Sequence
  Description of Artificial Sequence: Synthetic oligonucleotide
cggtagaaggagacaaggcc

SEQ ID NO: 6736 - DNA, 20 bp, Artificial Sequence
  Description of Artificial Sequence: Synthetic oligonucleotide
ggtagaaggagacaaggcca

SEQ ID NO: 6737 - DNA, 20 bp, Artificial Sequence
  Description of Artificial Sequence: Synthetic oligonucleotide
gtagaaggagacaaggccac

SEQ ID NO: 6738 - DNA, 20 bp, Artificial Sequence
  Description of Artificial Sequence: Synthetic oligonucleotide
tagaaggagacaaggccact

SEQ ID NO: 6739 - DNA, 20 bp, Artificial Sequence
  Description of Artificial Sequence: Synthetic oligonucleotide
agaaggagacaaggccactt

SEQ ID NO: 6740 - DNA, 20 bp, Artificial Sequence
  Description of Artificial Sequence: Synthetic oligonucleotide
gaaggagacaaggccacttt

SEQ ID NO: 6741 - DNA, 20 bp, Artificial Sequence
  Description of Artificial Sequence: Synthetic oligonucleotide
aaggagacaaggccactttt

SEQ ID NO: 6742 - DNA, 20 bp, Artificial Sequence
  Description of Artificial Sequence: Synthetic oligonucleotide
aggagacaaggccacttttt

SEQ ID NO: 6743 - DNA, 20 bp, Artificial Sequence
  Description of Artificial Sequence: Synthetic oligonucleotide
ggagacaaggccactttttc

SEQ ID NO: 6744 - DNA, 20 bp, Artificial Sequence
  Description of Artificial Sequence: Synthetic oligonucleotide
gagacaaggccactttttcg

SEQ ID NO: 6745 - DNA, 20 bp, Artificial Sequence
  Description of Artificial Sequence: Synthetic oligonucleotide
agacaaggccactttttcgt

SEQ ID NO: 6746 - DNA, 20 bp, Artificial Sequence
  Description of Artificial Sequence: Synthetic oligonucleotide
gacaaggccactttttcgtc

SEQ ID NO: 6747 - DNA, 20 bp, Artificial Sequence
  Description of Artificial Sequence: Synthetic oligonucleotide
acaaggccactttttcgtct

SEQ ID NO: 6748 - DNA, 20 bp, Artificial Sequence
  Description of Artificial Sequence: Synthetic oligonucleotide
caaggccactttttcgtctc

SEQ ID NO: 6749 - DNA, 20 bp, Artificial Sequence
  Description of Artificial Sequence: Synthetic oligonucleotide
aaggccactttttcgtctct

SEQ ID NO: 6750 - DNA, 20 bp, Artificial Sequence
  Description of Artificial Sequence: Synthetic oligonucleotide
aggccactttttcgtctctg

SEQ ID NO: 6751 - DNA, 20 bp, Artificial Sequence
  Description of Artificial Sequence: Synthetic oligonucleotide
ggccactttttcgtctctgg

SEQ ID NO: 6752 - DNA, 20 bp, Artificial Sequence
  Description of Artificial Sequence: Synthetic oligonucleotide
gccactttttcgtctctgga

SEQ ID NO: 6753 - DNA, 20 bp, Artificial Sequence
  Description of Artificial Sequence: Synthetic oligonucleotide
ccactttttcgtctctggat

SEQ ID NO: 6754 - DNA, 20 bp, Artificial Sequence
  Description of Artificial Sequence: Synthetic oligonucleotide
cactttttcgtctctggatg

SEQ ID NO: 6755 - DNA, 20 bp, Artificial Sequence
  Description of Artificial Sequence: Synthetic oligonucleotide
actttttcgtctctggatga

SEQ ID NO: 6756 - DNA, 20 bp, Artificial Sequence
  Description of Artificial Sequence: Synthetic oligonucleotide
ctttttcgtctctggatgat

SEQ ID NO: 6757 - DNA, 20 bp, Artificial Sequence
  Description of Artificial Sequence: Synthetic oligonucleotide
tttttcgtctctggatgatg

SEQ ID NO: 6758 - DNA, 20 bp, Artificial Sequence
  Description of Artificial Sequence: Synthetic oligonucleotide
ttttcgtctctggatgatgg

SEQ ID NO: 6759 - DNA, 20 bp, Artificial Sequence
  Description of Artificial Sequence: Synthetic oligonucleotide
tttcgtctctggatgatggt

SEQ ID NO: 6760 - DNA, 20 bp, Artificial Sequence
  Description of Artificial Sequence: Synthetic oligonucleotide
ttcgtctctggatgatggtc

SEQ ID NO: 6761 - DNA, 20 bp, Artificial Sequence
  Description of Artificial Sequence: Synthetic oligonucleotide
tcgtctctggatgatggtcc

SEQ ID NO: 6762 - DNA, 20 bp, Artificial Sequence
  Description of Artificial Sequence: Synthetic oligonucleotide
cgtctctggatgatggtcca

SEQ ID NO: 6763 - DNA, 20 bp, Artificial Sequence
  Description of Artificial Sequence: Synthetic oligonucleotide
gtctctggatgatggtccag

SEQ ID NO: 6764 - DNA, 20 bp, Artificial Sequence
  Description of Artificial Sequence: Synthetic oligonucleotide
tctctggatgatggtccagc

SEQ ID NO: 6765 - DNA, 20 bp, Artificial Sequence
  Description of Artificial Sequence: Synthetic oligonucleotide
ctctggatgatggtccagcc

SEQ ID NO: 6766 - DNA, 20 bp, Artificial Sequence
  Description of Artificial Sequence: Synthetic oligonucleotide
tctggatgatggtccagcct

SEQ ID NO: 6767 - DNA, 20 bp, Artificial Sequence
  Description of Artificial Sequence: Synthetic oligonucleotide
ctggatgatggtccagcctc

SEQ ID NO: 6768 - DNA, 20 bp, Artificial Sequence
  Description of Artificial Sequence: Synthetic oligonucleotide
tggatgatggtccagcctcc

SEQ ID NO: 6769 - DNA, 20 bp, Artificial Sequence
  Description of Artificial Sequence: Synthetic oligonucleotide
ggatgatggtccagcctccg

SEQ ID NO: 6770 - DNA, 20 bp, Artificial Sequence
  Description of Artificial Sequence: Synthetic oligonucleotide
gatgatggtccagcctccgc

SEQ ID NO: 6771 - DNA, 20 bp, Artificial Sequence
  Description of Artificial Sequence: Synthetic oligonucleotide
atgatggtccagcctccgcc

SEQ ID NO: 6772 - DNA, 20 bp, Artificial Sequence
  Description of Artificial Sequence: Synthetic oligonucleotide
tgatggtccagcctccgcct

SEQ ID NO: 6773 - DNA, 20 bp, Artificial Sequence
  Description of Artificial Sequence: Synthetic oligonucleotide
gatggtccagcctccgcctg

SEQ ID NO: 6774 - DNA, 20 bp, Artificial Sequence
  Description of Artificial Sequence: Synthetic oligonucleotide
atggtccagcctccgcctga

SEQ ID NO: 6775 - DNA, 20 bp, Artificial Sequence
  Description of Artificial Sequence: Synthetic oligonucleotide
tggtccagcctccgcctgaa

SEQ ID NO: 6776 - DNA, 20 bp, Artificial Sequence
  Description of Artificial Sequence: Synthetic oligonucleotide
ggtccagcctccgcctgaag

SEQ ID NO: 6777 - DNA, 20 bp, Artificial Sequence
  Description of Artificial Sequence: Synthetic oligonucleotide
gtccagcctccgcctgaagt

SEQ ID NO: 6778 - DNA, 20 bp, Artificial Sequence
  Description of Artificial Sequence: Synthetic oligonucleotide
tccagcctccgcctgaagtc

SEQ ID NO: 6779 - DNA, 20 bp, Artificial Sequence
  Description of Artificial Sequence: Synthetic oligonucleotide
ccagcctccgcctgaagtct

SEQ ID NO: 6780 - DNA, 20 bp, Artificial Sequence
  Description of Artificial Sequence: Synthetic oligonucleotide
cagcctccgcctgaagtctc

SEQ ID NO: 6781 - DNA, 20 bp, Artificial Sequence
  Description of Artificial Sequence: Synthetic oligonucleotide
agcctccgcctgaagtctcc

SEQ ID NO: 6782 - DNA, 20 bp, Artificial Sequence
  Description of Artificial Sequence: Synthetic oligonucleotide
gcctccgcctgaagtctcca

SEQ ID NO: 6783 - DNA, 20 bp, Artificial Sequence
  Description of Artificial Sequence: Synthetic oligonucleotide
cctccgcctgaagtctccat

SEQ ID NO: 6784 - DNA, 20 bp, Artificial Sequence
  Description of Artificial Sequence: Synthetic oligonucleotide
ctccgcctgaagtctccatg

SEQ ID NO: 6785 - DNA, 20 bp, Artificial Sequence
  Description of Artificial Sequence: Synthetic oligonucleotide
tccgcctgaagtctccatgt

SEQ ID NO: 6786 - DNA, 20 bp, Artificial Sequence
  Description of Artificial Sequence: Synthetic oligonucleotide
ccgcctgaagtctccatgtc

SEQ ID NO: 6787 - DNA, 20 bp, Artificial Sequence
  Description of Artificial Sequence: Synthetic oligonucleotide
cgcctgaagtctccatgtca

SEQ ID NO: 6788 - DNA, 20 bp, Artificial Sequence
  Description of Artificial Sequence: Synthetic oligonucleotide
gcctgaagtctccatgtcac

SEQ ID NO: 6789 - DNA, 20 bp, Artificial Sequence
  Description of Artificial Sequence: Synthetic oligonucleotide
cctgaagtctccatgtcaca

SEQ ID NO: 6790 - DNA, 20 bp, Artificial Sequence
  Description of Artificial Sequence: Synthetic oligonucleotide
ctgaagtctccatgtcacag

SEQ ID NO: 6791 - DNA, 20 bp, Artificial Sequence
  Description of Artificial Sequence: Synthetic oligonucleotide
tgaagtctccatgtcacaga

SEQ ID NO: 6792 - DNA, 20 bp, Artificial Sequence
  Description of Artificial Sequence: Synthetic oligonucleotide
gaagtctccatgtcacagaa

SEQ ID NO: 6793 - DNA, 20 bp, Artificial Sequence
  Description of Artificial Sequence: Synthetic oligonucleotide
aagtctccatgtcacagaac

SEQ ID NO: 6794 - DNA, 20 bp, Artificial Sequence
  Description of Artificial Sequence: Synthetic oligonucleotide
agtctccatgtcacagaaca

SEQ ID NO: 6795 - DNA, 20 bp, Artificial Sequence
  Description of Artificial Sequence: Synthetic oligonucleotide
gtctccatgtcacagaacac

SEQ ID NO: 6796 - DNA, 20 bp, Artificial Sequence
  Description of Artificial Sequence: Synthetic oligonucleotide
tctccatgtcacagaacacc

SEQ ID NO: 6797 - DNA, 20 bp, Artificial Sequence
  Description of Artificial Sequence: Synthetic oligonucleotide
ctccatgtcacagaacacct

SEQ ID NO: 6798 - DNA, 20 bp, Artificial Sequence
  Description of Artificial Sequence: Synthetic oligonucleotide
tccatgtcacagaacacctg

SEQ ID NO: 6799 - DNA, 20 bp, Artificial Sequence
  Description of Artificial Sequence: Synthetic oligonucleotide
ccatgtcacagaacacctga

SEQ ID NO: 6800 - DNA, 20 bp, Artificial Sequence
  Description of Artificial Sequence: Synthetic oligonucleotide
catgtcacagaacacctgaa

SEQ ID NO: 6801 - DNA, 20 bp, Artificial Sequence
  Description of Artificial Sequence: Synthetic oligonucleotide
atgtcacagaacacctgaag

SEQ ID NO: 6802 - DNA, 20 bp, Artificial Sequence
  Description of Artificial Sequence: Synthetic oligonucleotide
tgtcacagaacacctgaagc

SEQ ID NO: 6803 - DNA, 20 bp, Artificial Sequence
  Description of Artificial Sequence: Synthetic oligonucleotide
gtcacagaacacctgaagca

SEQ ID NO: 6804 - DNA, 20 bp, Artificial Sequence
  Description of Artificial Sequence: Synthetic oligonucleotide
tcacagaacacctgaagcag

SEQ ID NO: 6805 - DNA, 20 bp, Artificial Sequence
  Description of Artificial Sequence: Synthetic oligonucleotide
cacagaacacctgaagcaga

SEQ ID NO: 6806 - DNA, 20 bp, Artificial Sequence
  Description of Artificial Sequence: Synthetic oligonucleotide
acagaacacctgaagcagag

SEQ ID NO: 6807 - DNA, 20 bp, Artificial Sequence
  Description of Artificial Sequence: Synthetic oligonucleotide
cagaacacctgaagcagagg

SEQ ID NO: 6808 - DNA, 20 bp, Artificial Sequence
  Description of Artificial Sequence: Synthetic oligonucleotide
agaacacctgaagcagaggg

SEQ ID NO: 6809 - DNA, 20 bp, Artificial Sequence
  Description of Artificial Sequence: Synthetic oligonucleotide
gaacacctgaagcagagggg

SEQ ID NO: 6810 - DNA, 20 bp, Artificial Sequence
  Description of Artificial Sequence: Synthetic oligonucleotide
aacacctgaagcagagggga

SEQ ID NO: 6811 - DNA, 20 bp, Artificial Sequence
  Description of Artificial Sequence: Synthetic oligonucleotide
acacctgaagcagaggggat

SEQ ID NO: 6812 - DNA, 20 bp, Artificial Sequence
  Description of Artificial Sequence: Synthetic oligonucleotide
cacctgaagcagaggggata

SEQ ID NO: 6813 - DNA, 20 bp, Artificial Sequence
  Description of Artificial Sequence: Synthetic oligonucleotide
acctgaagcagaggggatac

SEQ ID NO: 6814 - DNA, 20 bp, Artificial Sequence
  Description of Artificial Sequence: Synthetic oligonucleotide
cctgaagcagaggggatact

SEQ ID NO: 6815 - DNA, 20 bp, Artificial Sequence
  Description of Artificial Sequence: Synthetic oligonucleotide
ctgaagcagaggggatactc

SEQ ID NO: 6816 - DNA, 20 bp, Artificial Sequence
  Description of Artificial Sequence: Synthetic oligonucleotide
tgaagcagaggggatactct

SEQ ID NO: 6817 - DNA, 20 bp, Artificial Sequence
  Description of Artificial Sequence: Synthetic oligonucleotide
gaagcagaggggatactctg

SEQ ID NO: 6818 - DNA, 20 bp, Artificial Sequence
  Description of Artificial Sequence: Synthetic oligonucleotide
aagcagaggggatactctgg

SEQ ID NO: 6819 - DNA, 20 bp, Artificial Sequence
  Description of Artificial Sequence: Synthetic oligonucleotide
agcagaggggatactctggt

SEQ ID NO: 6820 - DNA, 20 bp, Artificial Sequence
  Description of Artificial Sequence: Synthetic oligonucleotide
gcagaggggatactctggtg

SEQ ID NO: 6821 - DNA, 20 bp, Artificial Sequence
  Description of Artificial Sequence: Synthetic oligonucleotide
cagaggggatactctggtga

SEQ ID NO: 6822 - DNA, 20 bp, Artificial Sequence
  Description of Artificial Sequence: Synthetic oligonucleotide
agaggggatactctggtgag

SEQ ID NO: 6823 - DNA, 20 bp, Artificial Sequence
  Description of Artificial Sequence: Synthetic oligonucleotide
gaggggatactctggtgagg

SEQ ID NO: 6824 - DNA, 20 bp, Artificial Sequence
  Description of Artificial Sequence: Synthetic oligonucleotide
aggggatactctggtgaggg

SEQ ID NO: 6825 - DNA, 20 bp, Artificial Sequence
  Description of Artificial Sequence: Synthetic oligonucleotide
ggggatactctggtgaggga

SEQ ID NO: 6826 - DNA, 20 bp, Artificial Sequence
  Description of Artificial Sequence: Synthetic oligonucleotide
gggatactctggtgagggac

SEQ ID NO: 6827 - DNA, 20 bp, Artificial Sequence
  Description of Artificial Sequence: Synthetic oligonucleotide
ggatactctggtgagggact

SEQ ID NO: 6828 - DNA, 20 bp, Artificial Sequence
  Description of Artificial Sequence: Synthetic oligonucleotide
gatactctggtgagggactt

SEQ ID NO: 6829 - DNA, 20 bp, Artificial Sequence
  Description of Artificial Sequence: Synthetic oligonucleotide
atactctggtgagggacttg

SEQ ID NO: 6830 - DNA, 20 bp, Artificial Sequence
  Description of Artificial Sequence: Synthetic oligonucleotide
tactctggtgagggacttgc

SEQ ID NO: 6831 - DNA, 20 bp, Artificial Sequence
  Description of Artificial Sequence: Synthetic oligonucleotide
actctggtgagggacttgca

SEQ ID NO: 6832 - DNA, 20 bp, Artificial Sequence
  Description of Artificial Sequence: Synthetic oligonucleotide
ctctggtgagggacttgcag

SEQ ID NO: 6833 - DNA, 20 bp, Artificial Sequence
  Description of Artificial Sequence: Synthetic oligonucleotide
tctggtgagggacttgcagg

SEQ ID NO: 6834 - DNA, 20 bp, Artificial Sequence
  Description of Artificial Sequence: Synthetic oligonucleotide
ctggtgagggacttgcaggg

SEQ ID NO: 6835 - DNA, 20 bp, Artificial Sequence
  Description of Artificial Sequence: Synthetic oligonucleotide
tggtgagggacttgcagggg

SEQ ID NO: 6836 - DNA, 20 bp, Artificial Sequence
  Description of Artificial Sequence: Synthetic oligonucleotide
ggtgagggacttgcaggggc

SEQ ID NO: 6837 - DNA, 20 bp, Artificial Sequence
  Description of Artificial Sequence: Synthetic oligonucleotide
gtgagggacttgcaggggca

SEQ ID NO: 6838 - DNA, 20 bp, Artificial Sequence
  Description of Artificial Sequence: Synthetic oligonucleotide
tgagggacttgcaggggcag

SEQ ID NO: 6839 - DNA, 20 bp, Artificial Sequence
  Description of Artificial Sequence: Synthetic oligonucleotide
gagggacttgcaggggcaga

SEQ ID NO: 6840 - DNA, 20 bp, Artificial Sequence
  Description of Artificial Sequence: Synthetic oligonucleotide
agggacttgcaggggcagaa

SEQ ID NO: 6841 - DNA, 20 bp, Artificial Sequence
  Description of Artificial Sequence: Synthetic oligonucleotide
gggacttgcaggggcagaag

SEQ ID NO: 6842 - DNA, 20 bp, Artificial Sequence
  Description of Artificial Sequence: Synthetic oligonucleotide
ggacttgcaggggcagaagg

SEQ ID NO: 6843 - DNA, 20 bp, Artificial Sequence
  Description of Artificial Sequence: Synthetic oligonucleotide
gacttgcaggggcagaaggc

SEQ ID NO: 6844 - DNA, 20 bp, Artificial Sequence
  Description of Artificial Sequence: Synthetic oligonucleotide
acttgcaggggcagaaggca

SEQ ID NO: 6845 - DNA, 20 bp, Artificial Sequence
  Description of Artificial Sequence: Synthetic oligonucleotide
cttgcaggggcagaaggcag

SEQ ID NO: 6846 - DNA, 20 bp, Artificial Sequence
  Description of Artificial Sequence: Synthetic oligonucleotide
ttgcaggggcagaaggcagg

SEQ ID NO: 6847 - DNA, 20 bp, Artificial Sequence
  Description of Artificial Sequence: Synthetic oligonucleotide
tgcaggggcagaaggcagga

SEQ ID NO: 6848 - DNA, 20 bp, Artificial Sequence
  Description of Artificial Sequence: Synthetic oligonucleotide
gcaggggcagaaggcaggag

SEQ ID NO: 6849 - DNA, 20 bp, Artificial Sequence
  Description of Artificial Sequence: Synthetic oligonucleotide
caggggcagaaggcaggagc

SEQ ID NO: 6850 - DNA, 20 bp, Artificial Sequence
  Description of Artificial Sequence: Synthetic oligonucleotide
aggggcagaaggcaggagca

SEQ ID NO: 6851 - DNA, 20 bp, Artificial Sequence
  Description of Artificial Sequence: Synthetic oligonucleotide
ggggcagaaggcaggagcaa

SEQ ID NO: 6852 - DNA, 20 bp, Artificial Sequence
  Description of Artificial Sequence: Synthetic oligonucleotide
gggcagaaggcaggagcaag

SEQ ID NO: 6853 - DNA, 20 bp, Artificial Sequence
  Description of Artificial Sequence: Synthetic oligonucleotide
ggcagaaggcaggagcaaga

SEQ ID NO: 6854 - DNA, 20 bp, Artificial Sequence
  Description of Artificial Sequence: Synthetic oligonucleotide
gcagaaggcaggagcaagag

SEQ ID NO: 6855 - DNA, 20 bp, Artificial Sequence
  Description of Artificial Sequence: Synthetic oligonucleotide
cagaaggcaggagcaagagg

SEQ ID NO: 6856 - DNA, 20 bp, Artificial Sequence
  Description of Artificial Sequence: Synthetic oligonucleotide
agaaggcaggagcaagaggg

SEQ ID NO: 6857 - DNA, 20 bp, Artificial Sequence
  Description of Artificial Sequence: Synthetic oligonucleotide
gaaggcaggagcaagagggc

SEQ ID NO: 6858 - DNA, 20 bp, Artificial Sequence
  Description of Artificial Sequence: Synthetic oligonucleotide
aaggcaggagcaagagggca

SEQ ID NO: 6859 - DNA, 20 bp, Artificial Sequence
  Description of Artificial Sequence: Synthetic oligonucleotide
aggcaggagcaagagggcag

SEQ ID NO: 6860 - DNA, 20 bp, Artificial Sequence
  Description of Artificial Sequence: Synthetic oligonucleotide
ggcaggagcaagagggcagg

SEQ ID NO: 6861 - DNA, 20 bp, Artificial Sequence
  Description of Artificial Sequence: Synthetic oligonucleotide
gcaggagcaagagggcaggc

SEQ ID NO: 6862 - DNA, 20 bp, Artificial Sequence
  Description of Artificial Sequence: Synthetic oligonucleotide
caggagcaagagggcaggct

SEQ ID NO: 6863 - DNA, 20 bp, Artificial Sequence
  Description of Artificial Sequence: Synthetic oligonucleotide
aggagcaagagggcaggctt

SEQ ID NO: 6864 - DNA, 20 bp, Artificial Sequence
  Description of Artificial Sequence: Synthetic oligonucleotide
ggagcaagagggcaggcttc

SEQ ID NO: 6865 - DNA, 20 bp, Artificial Sequence
  Description of Artificial Sequence: Synthetic oligonucleotide
gagcaagagggcaggcttcc

SEQ ID NO: 6866 - DNA, 20 bp, Artificial Sequence
  Description of Artificial Sequence: Synthetic oligonucleotide
agcaagagggcaggcttccc

SEQ ID NO: 6867 - DNA, 20 bp, Artificial Sequence
  Description of Artificial Sequence: Synthetic oligonucleotide
gcaagagggcaggcttccca

SEQ ID NO: 6868 - DNA, 20 bp, Artificial Sequence
  Description of Artificial Sequence: Synthetic oligonucleotide
caagagggcaggcttcccaa

SEQ ID NO: 6869 - DNA, 20 bp, Artificial Sequence
  Description of Artificial Sequence: Synthetic oligonucleotide
aagagggcaggcttcccaac

SEQ ID NO: 6870 - DNA, 20 bp, Artificial Sequence
  Description of Artificial Sequence: Synthetic oligonucleotide
agagggcaggcttcccaacc

SEQ ID NO: 6871 - DNA, 20 bp, Artificial Sequence
  Description of Artificial Sequence: Synthetic oligonucleotide
gagggcaggcttcccaacct

SEQ ID NO: 6872 - DNA, 20 bp, Artificial Sequence
  Description of Artificial Sequence: Synthetic oligonucleotide
agggcaggcttcccaacctg

SEQ ID NO: 6873 - DNA, 20 bp, Artificial Sequence
  Description of Artificial Sequence: Synthetic oligonucleotide
gggcaggcttcccaacctgt

SEQ ID NO: 6874 - DNA, 20 bp, Artificial Sequence
  Description of Artificial Sequence: Synthetic oligonucleotide
ggcaggcttcccaacctgtt

SEQ ID NO: 6875 - DNA, 20 bp, Artificial Sequence
  Description of Artificial Sequence: Synthetic oligonucleotide
gcaggcttcccaacctgttc

SEQ ID NO: 6876 - DNA, 20 bp, Artificial Sequence
  Description of Artificial Sequence: Synthetic oligonucleotide
caggcttcccaacctgttcc

SEQ ID NO: 6877 - DNA, 20 bp, Artificial Sequence
  Description of Artificial Sequence: Synthetic oligonucleotide
aggcttcccaacctgttcct

SEQ ID NO: 6878 - DNA, 20 bp, Artificial Sequence
  Description of Artificial Sequence: Synthetic oligonucleotide
ggcttcccaacctgttcctg

SEQ ID NO: 6879 - DNA, 20 bp, Artificial Sequence
  Description of Artificial Sequence: Synthetic oligonucleotide
gcttcccaacctgttcctgt

SEQ ID NO: 6880 - DNA, 20 bp, Artificial Sequence
  Description of Artificial Sequence: Synthetic oligonucleotide
cttcccaacctgttcctgtc

SEQ ID NO: 6881 - DNA, 20 bp, Artificial Sequence
  Description of Artificial Sequence: Synthetic oligonucleotide
ttcccaacctgttcctgtcc

SEQ ID NO: 6882 - DNA, 20 bp, Artificial Sequence
  Description of Artificial Sequence: Synthetic oligonucleotide
tcccaacctgttcctgtccc

SEQ ID NO: 6883 - DNA, 20 bp, Artificial Sequence
  Description of Artificial Sequence: Synthetic oligonucleotide
cccaacctgttcctgtccct

SEQ ID NO: 6884 - DNA, 20 bp, Artificial Sequence
  Description of Artificial Sequence: Synthetic oligonucleotide
ccaacctgttcctgtccctg

SEQ ID NO: 6885 - DNA, 20 bp, Artificial Sequence
  Description of Artificial Sequence: Synthetic oligonucleotide
caacctgttcctgtccctgc

SEQ ID NO: 6886 - DNA, 20 bp, Artificial Sequence
  Description of Artificial Sequence: Synthetic oligonucleotide
aacctgttcctgtccctgca

SEQ ID NO: 6887 - DNA, 20 bp, Artificial Sequence
  Description of Artificial Sequence: Synthetic oligonucleotide
acctgttcctgtccctgcag

SEQ ID NO: 6888 - DNA, 20 bp, Artificial Sequence
  Description of Artificial Sequence: Synthetic oligonucleotide
cctgttcctgtccctgcaga

SEQ ID NO: 6889 - DNA, 20 bp, Artificial Sequence
  Description of Artificial Sequence: Synthetic oligonucleotide
ctgttcctgtccctgcagag

SEQ ID NO: 6890 - DNA, 20 bp, Artificial Sequence
  Description of Artificial Sequence: Synthetic oligonucleotide
tgttcctgtccctgcagagc

SEQ ID NO: 6891 - DNA, 20 bp, Artificial Sequence
  Description of Artificial Sequence: Synthetic oligonucleotide
gttcctgtccctgcagagcc

SEQ ID NO: 6892 - DNA, 20 bp, Artificial Sequence
  Description of Artificial Sequence: Synthetic oligonucleotide
ttcctgtccctgcagagcca

SEQ ID NO: 6893 - DNA, 20 bp, Artificial Sequence
  Description of Artificial Sequence: Synthetic oligonucleotide
tcctgtccctgcagagccag

SEQ ID NO: 6894 - DNA, 20 bp, Artificial Sequence
  Description of Artificial Sequence: Synthetic oligonucleotide
cctgtccctgcagagccagt

SEQ ID NO: 6895 - DNA, 20 bp, Artificial Sequence
  Description of Artificial Sequence: Synthetic oligonucleotide
ctgtccctgcagagccagta

SEQ ID NO: 6896 - DNA, 20 bp, Artificial Sequence
  Description of Artificial Sequence: Synthetic oligonucleotide
tgtccctgcagagccagtag

SEQ ID NO: 6897 - DNA, 20 bp, Artificial Sequence
  Description of Artificial Sequence: Synthetic oligonucleotide
gtccctgcagagccagtaga

SEQ ID NO: 6898 - DNA, 20 bp, Artificial Sequence
  Description of Artificial Sequence: Synthetic oligonucleotide
tccctgcagagccagtagat

SEQ ID NO: 6899 - DNA, 20 bp, Artificial Sequence
  Description of Artificial Sequence: Synthetic oligonucleotide
ccctgcagagccagtagatg

SEQ ID NO: 6900 - DNA, 20 bp, Artificial Sequence
  Description of Artificial Sequence: Synthetic oligonucleotide
cctgcagagccagtagatgt

SEQ ID NO: 6901 - DNA, 20 bp, Artificial Sequence
  Description of Artificial Sequence: Synthetic oligonucleotide
ctgcagagccagtagatgtg

SEQ ID NO: 6902 - DNA, 20 bp, Artificial Sequence
  Description of Artificial Sequence: Synthetic oligonucleotide
tgcagagccagtagatgtgt

SEQ ID NO: 6903 - DNA, 20 bp, Artificial Sequence
  Description of Artificial Sequence: Synthetic oligonucleotide
gcagagccagtagatgtgtg

SEQ ID NO: 6904 - DNA, 20 bp, Artificial Sequence
  Description of Artificial Sequence: Synthetic oligonucleotide
cagagccagtagatgtgtgc

SEQ ID NO: 6905 - DNA, 20 bp, Artificial Sequence
  Description of Artificial Sequence: Synthetic oligonucleotide
agagccagtagatgtgtgca

SEQ ID NO: 6906 - DNA, 20 bp, Artificial Sequence
  Description of Artificial Sequence: Synthetic oligonucleotide
gagccagtagatgtgtgcac

SEQ ID NO: 6907 - DNA, 20 bp, Artificial Sequence
  Description of Artificial Sequence: Synthetic oligonucleotide
agccagtagatgtgtgcact

SEQ ID NO: 6908 - DNA, 20 bp, Artificial Sequence
  Description of Artificial Sequence: Synthetic oligonucleotide
gccagtagatgtgtgcactc

SEQ ID NO: 6909 - DNA, 20 bp, Artificial Sequence
  Description of Artificial Sequence: Synthetic oligonucleotide
ccagtagatgtgtgcactcc

SEQ ID NO: 6910 - DNA, 20 bp, Artificial Sequence
  Description of Artificial Sequence: Synthetic oligonucleotide
cagtagatgtgtgcactccc

SEQ ID NO: 6911 - DNA, 20 bp, Artificial Sequence
  Description of Artificial Sequence: Synthetic oligonucleotide
agtagatgtgtgcactcccg

SEQ ID NO: 6912 - DNA, 20 bp, Artificial Sequence
  Description of Artificial Sequence: Synthetic oligonucleotide
gtagatgtgtgcactcccgc

SEQ ID NO: 6913 - DNA, 20 bp, Artificial Sequence
  Description of Artificial Sequence: Synthetic oligonucleotide
tagatgtgtgcactcccgca

SEQ ID NO: 6914 - DNA, 20 bp, Artificial Sequence
  Description of Artificial Sequence: Synthetic oligonucleotide
agatgtgtgcactcccgcag

SEQ ID NO: 6915 - DNA, 20 bp, Artificial Sequence
  Description of Artificial Sequence: Synthetic oligonucleotide
gatgtgtgcactcccgcagt

SEQ ID NO: 6916 - DNA, 20 bp, Artificial Sequence
  Description of Artificial Sequence: Synthetic oligonucleotide
atgtgtgcactcccgcagtc

SEQ ID NO: 6917 - DNA, 20 bp, Artificial Sequence
  Description of Artificial Sequence: Synthetic oligonucleotide
tgtgtgcactcccgcagtca

SEQ ID NO: 6918 - DNA, 20 bp, Artificial Sequence
  Description of Artificial Sequence: Synthetic oligonucleotide
gtgtgcactcccgcagtcac

SEQ ID NO: 6919 - DNA, 20 bp, Artificial Sequence
  Description of Artificial Sequence: Synthetic oligonucleotide
tgtgcactcccgcagtcaca

SEQ ID NO: 6920 - DNA, 20 bp, Artificial Sequence
  Description of Artificial Sequence: Synthetic oligonucleotide
gtgcactcccgcagtcacac

SEQ ID NO: 6921 - DNA, 20 bp, Artificial Sequence
  Description of Artificial Sequence: Synthetic oligonucleotide
tgcactcccgcagtcacact

SEQ ID NO: 6922 - DNA, 20 bp, Artificial Sequence
  Description of Artificial Sequence: Synthetic oligonucleotide
gcactcccgcagtcacactg

SEQ ID NO: 6923 - DNA, 20 bp, Artificial Sequence
  Description of Artificial Sequence: Synthetic oligonucleotide
cactcccgcagtcacactgg

SEQ ID NO: 6924 - DNA, 20 bp, Artificial Sequence
  Description of Artificial Sequence: Synthetic oligonucleotide
actcccgcagtcacactggc

SEQ ID NO: 6925 - DNA, 20 bp, Artificial Sequence
  Description of Artificial Sequence: Synthetic oligonucleotide
ctcccgcagtcacactggct

SEQ ID NO: 6926 - DNA, 20 bp, Artificial Sequence
  Description of Artificial Sequence: Synthetic oligonucleotide
tcccgcagtcacactggctc

SEQ ID NO: 6927 - DNA, 20 bp, Artificial Sequence
  Description of Artificial Sequence: Synthetic oligonucleotide
cccgcagtcacactggctca

SEQ ID NO: 6928 - DNA, 20 bp, Artificial Sequence
  Description of Artificial Sequence: Synthetic oligonucleotide
ccgcagtcacactggctcac

SEQ ID NO: 6929 - DNA, 20 bp, Artificial Sequence
  Description of Artificial Sequence: Synthetic oligonucleotide
cgcagtcacactggctcact

SEQ ID NO: 6930 - DNA, 20 bp, Artificial Sequence
  Description of Artificial Sequence: Synthetic oligonucleotide
gcagtcacactggctcactc

SEQ ID NO: 6931 - DNA, 20 bp, Artificial Sequence
  Description of Artificial Sequence: Synthetic oligonucleotide
cagtcacactggctcactcg

SEQ ID NO: 6932 - DNA, 20 bp, Artificial Sequence
  Description of Artificial Sequence: Synthetic oligonucleotide
agtcacactggctcactcgg

SEQ ID NO: 6933 - DNA, 20 bp, Artificial Sequence
  Description of Artificial Sequence: Synthetic oligonucleotide
gtcacactggctcactcggg

SEQ ID NO: 6934 - DNA, 20 bp, Artificial Sequence
  Description of Artificial Sequence: Synthetic oligonucleotide
tcacactggctcactcgggc

SEQ ID NO: 6935 - DNA, 20 bp, Artificial Sequence
  Description of Artificial Sequence: Synthetic oligonucleotide
cacactggctcactcgggca

SEQ ID NO: 6936 - DNA, 20 bp, Artificial Sequence
  Description of Artificial Sequence: Synthetic oligonucleotide
acactggctcactcgggcag

SEQ ID NO: 6937 - DNA, 20 bp, Artificial Sequence
  Description of Artificial Sequence: Synthetic oligonucleotide
cactggctcactcgggcagt

SEQ ID NO: 6938 - DNA, 20 bp, Artificial Sequence
  Description of Artificial Sequence: Synthetic oligonucleotide
actggctcactcgggcagtg

SEQ ID NO: 6939 - DNA, 20 bp, Artificial Sequence
  Description of Artificial Sequence: Synthetic oligonucleotide
ctggctcactcgggcagtga

SEQ ID NO: 6940 - DNA, 20 bp, Artificial Sequence
  Description of Artificial Sequence: Synthetic oligonucleotide
tggctcactcgggcagtgat

SEQ ID NO: 6941 - DNA, 20 bp, Artificial Sequence
  Description of Artificial Sequence: Synthetic oligonucleotide
ggctcactcgggcagtgatg

SEQ ID NO: 6942 - DNA, 20 bp, Artificial Sequence
  Description of Artificial Sequence: Synthetic oligonucleotide
gctcactcgggcagtgatgc

SEQ ID NO: 6943 - DNA, 20 bp, Artificial Sequence
  Description of Artificial Sequence: Synthetic oligonucleotide
ctcactcgggcagtgatgct

SEQ ID NO: 6944 - DNA, 20 bp, Artificial Sequence
  Description of Artificial Sequence: Synthetic oligonucleotide
tcactcgggcagtgatgctg

SEQ ID NO: 6945 - DNA, 20 bp, Artificial Sequence
  Description of Artificial Sequence: Synthetic oligonucleotide
cactcgggcagtgatgctgc

SEQ ID NO: 6946 - DNA, 20 bp, Artificial Sequence
  Description of Artificial Sequence: Synthetic oligonucleotide
actcgggcagtgatgctgcc

SEQ ID NO: 6947 - DNA, 20 bp, Artificial Sequence
  Description of Artificial Sequence: Synthetic oligonucleotide
ctcgggcagtgatgctgccc

SEQ ID NO: 6948 - DNA, 20 bp, Artificial Sequence
  Description of Artificial Sequence: Synthetic oligonucleotide
tcgggcagtgatgctgcccc

SEQ ID NO: 6949 - DNA, 20 bp, Artificial Sequence
  Description of Artificial Sequence: Synthetic oligonucleotide
cgggcagtgatgctgcccca

SEQ ID NO: 6950 - DNA, 20 bp, Artificial Sequence
  Description of Artificial Sequence: Synthetic oligonucleotide
gggcagtgatgctgccccac

SEQ ID NO: 6951 - DNA, 20 bp, Artificial Sequence
  Description of Artificial Sequence: Synthetic oligonucleotide
ggcagtgatgctgccccact

SEQ ID NO: 6952 - DNA, 20 bp, Artificial Sequence
  Description of Artificial Sequence: Synthetic oligonucleotide
gcagtgatgctgccccactg

SEQ ID NO: 6953 - DNA, 20 bp, Artificial Sequence
  Description of Artificial Sequence: Synthetic oligonucleotide
cagtgatgctgccccactgc

SEQ ID NO: 6954 - DNA, 20 bp, Artificial Sequence
  Description of Artificial Sequence: Synthetic oligonucleotide
agtgatgctgccccactgct

SEQ ID NO: 6955 - DNA, 20 bp, Artificial Sequence
  Description of Artificial Sequence: Synthetic oligonucleotide
gtgatgctgccccactgctg

SEQ ID NO: 6956 - DNA, 20 bp, Artificial Sequence
  Description of Artificial Sequence: Synthetic oligonucleotide
tgatgctgccccactgctgg

SEQ ID NO: 6957 - DNA, 20 bp, Artificial Sequence
  Description of Artificial Sequence: Synthetic oligonucleotide
gatgctgccccactgctggt

SEQ ID NO: 6958 - DNA, 20 bp, Artificial Sequence
  Description of Artificial Sequence: Synthetic oligonucleotide
atgctgccccactgctggtg

SEQ ID NO: 6959 - DNA, 20 bp, Artificial Sequence
  Description of Artificial Sequence: Synthetic oligonucleotide
tgctgccccactgctggtga

SEQ ID NO: 6960 - DNA, 20 bp, Artificial Sequence
  Description of Artificial Sequence: Synthetic oligonucleotide
gctgccccactgctggtgag

SEQ ID NO: 6961 - DNA, 20 bp, Artificial Sequence
  Description of Artificial Sequence: Synthetic oligonucleotide
ctgccccactgctggtgagc

SEQ ID NO: 6962 - DNA, 20 bp, Artificial Sequence
  Description of Artificial Sequence: Synthetic oligonucleotide
tgccccactgctggtgagct

SEQ ID NO: 6963 - DNA, 20 bp, Artificial Sequence
  Description of Artificial Sequence: Synthetic oligonucleotide
gccccactgctggtgagctg

SEQ ID NO: 6964 - DNA, 20 bp, Artificial Sequence
  Description of Artificial Sequence: Synthetic oligonucleotide
ccccactgctggtgagctgg

SEQ ID NO: 6965 - DNA, 20 bp, Artificial Sequence
  Description of Artificial Sequence: Synthetic oligonucleotide
cccactgctggtgagctggg

SEQ ID NO: 6966 - DNA, 20 bp, Artificial Sequence
  Description of Artificial Sequence: Synthetic oligonucleotide
ccactgctggtgagctgggg

SEQ ID NO: 6967 - DNA, 20 bp, Artificial Sequence
  Description of Artificial Sequence: Synthetic oligonucleotide
cactgctggtgagctggggt

SEQ ID NO: 6968 - DNA, 20 bp, Artificial Sequence
  Description of Artificial Sequence: Synthetic oligonucleotide
actgctggtgagctggggtg

SEQ ID NO: 6969 - DNA, 20 bp, Artificial Sequence
  Description of Artificial Sequence: Synthetic oligonucleotide
ctgctggtgagctggggtgg

SEQ ID NO: 6970 - DNA, 20 bp, Artificial Sequence
  Description of Artificial Sequence: Synthetic oligonucleotide
tgctggtgagctggggtggg

SEQ ID NO: 6971 - DNA, 20 bp, Artificial Sequence
  Description of Artificial Sequence: Synthetic oligonucleotide
gctggtgagctggggtgggt

SEQ ID NO: 6972 - DNA, 20 bp, Artificial Sequence
  Description of Artificial Sequence: Synthetic oligonucleotide
ctggtgagctggggtgggtg

SEQ ID NO: 6973 - DNA, 20 bp, Artificial Sequence
  Description of Artificial Sequence: Synthetic oligonucleotide
tggtgagctggggtgggtgg

SEQ ID NO: 6974 - DNA, 20 bp, Artificial Sequence
  Description of Artificial Sequence: Synthetic oligonucleotide
ggtgagctggggtgggtggt

SEQ ID NO: 6975 - DNA, 20 bp, Artificial Sequence
  Description of Artificial Sequence: Synthetic oligonucleotide
gtgagctggggtgggtggtg

SEQ ID NO: 6976 - DNA, 20 bp, Artificial Sequence
  Description of Artificial Sequence: Synthetic oligonucleotide
tgagctggggtgggtggtgc

SEQ ID NO: 6977 - DNA, 20 bp, Artificial Sequence
  Description of Artificial Sequence: Synthetic oligonucleotide
gagctggggtgggtggtgca

SEQ ID NO: 6978 - DNA, 20 bp, Artificial Sequence
  Description of Artificial Sequence: Synthetic oligonucleotide
agctggggtgggtggtgcat

SEQ ID NO: 6979 - DNA, 20 bp, Artificial Sequence
  Description of Artificial Sequence: Synthetic oligonucleotide
gctggggtgggtggtgcatt

SEQ ID NO: 6980 - DNA, 20 bp, Artificial Sequence
  Description of Artificial Sequence: Synthetic oligonucleotide
ctggggtgggtggtgcattg

SEQ ID NO: 6981 - DNA, 20 bp, Artificial Sequence
  Description of Artificial Sequence: Synthetic oligonucleotide
tggggtgggtggtgcattgc

SEQ ID NO: 6982 - DNA, 20 bp, Artificial Sequence
  Description of Artificial Sequence: Synthetic oligonucleotide
ggggtgggtggtgcattgct

SEQ ID NO: 6983 - DNA, 20 bp, Artificial Sequence
  Description of Artificial Sequence: Synthetic oligonucleotide
gggtgggtggtgcattgctc

SEQ ID NO: 6984 - DNA, 20 bp, Artificial Sequence
  Description of Artificial Sequence: Synthetic oligonucleotide
ggtgggtggtgcattgctct

SEQ ID NO: 6985 - DNA, 20 bp, Artificial Sequence
  Description of Artificial Sequence: Synthetic oligonucleotide
gtgggtggtgcattgctctg

SEQ ID NO: 6986 - DNA, 20 bp, Artificial Sequence
  Description of Artificial Sequence: Synthetic oligonucleotide
tgggtggtgcattgctctgg

SEQ ID NO: 6987 - DNA, 20 bp, Artificial Sequence
  Description of Artificial Sequence: Synthetic oligonucleotide
gggtggtgcattgctctgga

SEQ ID NO: 6988 - DNA, 20 bp, Artificial Sequence
  Description of Artificial Sequence: Synthetic oligonucleotide
ggtggtgcattgctctggaa

SEQ ID NO: 6989 - DNA, 20 bp, Artificial Sequence
  Description of Artificial Sequence: Synthetic oligonucleotide
gtggtgcattgctctggaag

SEQ ID NO: 6990 - DNA, 20 bp, Artificial Sequence
  Description of Artificial Sequence: Synthetic oligonucleotide
tggtgcattgctctggaaga

SEQ ID NO: 6991 - DNA, 20 bp, Artificial Sequence
  Description of Artificial Sequence: Synthetic oligonucleotide
ggtgcattgctctggaagaa

SEQ ID NO: 6992 - DNA, 20 bp, Artificial Sequence
  Description of Artificial Sequence: Synthetic oligonucleotide
gtgcattgctctggaagaac

SEQ ID NO: 6993 - DNA, 20 bp, Artificial Sequence
  Description of Artificial Sequence: Synthetic oligonucleotide
tgcattgctctggaagaacg

SEQ ID NO: 6994 - DNA, 20 bp, Artificial Sequence
  Description of Artificial Sequence: Synthetic oligonucleotide
gcattgctctggaagaacga

SEQ ID NO: 6995 - DNA, 20 bp, Artificial Sequence
  Description of Artificial Sequence: Synthetic oligonucleotide
cattgctctggaagaacgat

SEQ ID NO: 6996 - DNA, 20 bp, Artificial Sequence
  Description of Artificial Sequence: Synthetic oligonucleotide
attgctctggaagaacgatg

SEQ ID NO: 6997 - DNA, 20 bp, Artificial Sequence
  Description of Artificial Sequence: Synthetic oligonucleotide
ttgctctggaagaacgatgc

SEQ ID NO: 6998 - DNA, 20 bp, Artificial Sequence
  Description of Artificial Sequence: Synthetic oligonucleotide
tgctctggaagaacgatgca

SEQ ID NO: 6999 - DNA, 20 bp, Artificial Sequence
  Description of Artificial Sequence: Synthetic oligonucleotide
gctctggaagaacgatgcaa

SEQ ID NO: 7000 - DNA, 20 bp, Artificial Sequence
  Description of Artificial Sequence: Synthetic oligonucleotide
ctctggaagaacgatgcaaa

SEQ ID NO: 7001 - DNA, 20 bp, Artificial Sequence
  Description of Artificial Sequence: Synthetic oligonucleotide
tctggaagaacgatgcaaat

SEQ ID NO: 7002 - DNA, 20 bp, Artificial Sequence
  Description of Artificial Sequence: Synthetic oligonucleotide
ctggaagaacgatgcaaatt

SEQ ID NO: 7003 - DNA, 20 bp, Artificial Sequence
  Description of Artificial Sequence: Synthetic oligonucleotide
tggaagaacgatgcaaattg

SEQ ID NO: 7004 - DNA, 20 bp, Artificial Sequence
  Description of Artificial Sequence: Synthetic oligonucleotide
ggaagaacgatgcaaattgg

SEQ ID NO: 7005 - DNA, 20 bp, Artificial Sequence
  Description of Artificial Sequence: Synthetic oligonucleotide
gaagaacgatgcaaattggg

SEQ ID NO: 7006 - DNA, 20 bp, Artificial Sequence
  Description of Artificial Sequence: Synthetic oligonucleotide
aagaacgatgcaaattgggc

SEQ ID NO: 7007 - DNA, 20 bp, Artificial Sequence
  Description of Artificial Sequence: Synthetic oligonucleotide
agaacgatgcaaattgggcc

SEQ ID NO: 7008 - DNA, 20 bp, Artificial Sequence
  Description of Artificial Sequence: Synthetic oligonucleotide
gaacgatgcaaattgggccc

SEQ ID NO: 7009 - DNA, 20 bp, Artificial Sequence
  Description of Artificial Sequence: Synthetic oligonucleotide
aacgatgcaaattgggcccg

SEQ ID NO: 7010 - DNA, 20 bp, Artificial Sequence
  Description of Artificial Sequence: Synthetic oligonucleotide
acgatgcaaattgggcccgg

SEQ ID NO: 7011 - DNA, 20 bp, Artificial Sequence
  Description of Artificial Sequence: Synthetic oligonucleotide
cgatgcaaattgggcccggg

SEQ ID NO: 7012 - DNA, 20 bp, Artificial Sequence
  Description of Artificial Sequence: Synthetic oligonucleotide
gatgcaaattgggcccgggg

SEQ ID NO: 7013 - DNA, 20 bp, Artificial Sequence
  Description of Artificial Sequence: Synthetic oligonucleotide
atgcaaattgggcccggggg

SEQ ID NO: 7014 - DNA, 20 bp, Artificial Sequence
  Description of Artificial Sequence: Synthetic oligonucleotide
tgcaaattgggcccgggggt

SEQ ID NO: 7015 - DNA, 20 bp, Artificial Sequence
  Description of Artificial Sequence: Synthetic oligonucleotide
gcaaattgggcccgggggtg

SEQ ID NO: 7016 - DNA, 20 bp, Artificial Sequence
  Description of Artificial Sequence: Synthetic oligonucleotide
caaattgggcccgggggtga

SEQ ID NO: 7017 - DNA, 20 bp, Artificial Sequence
  Description of Artificial Sequence: Synthetic oligonucleotide
aaattgggcccgggggtgag

SEQ ID NO: 7018 - DNA, 20 bp, Artificial Sequence
  Description of Artificial Sequence: Synthetic oligonucleotide
aattgggcccgggggtgagt

SEQ ID NO: 7019 - DNA, 20 bp, Artificial Sequence
  Description of Artificial Sequence: Synthetic oligonucleotide
attgggcccgggggtgagtg

SEQ ID NO: 7020 - DNA, 20 bp, Artificial Sequence
  Description of Artificial Sequence: Synthetic oligonucleotide
ttgggcccgggggtgagtgc

SEQ ID NO: 7021 - DNA, 20 bp, Artificial Sequence
  Description of Artificial Sequence: Synthetic oligonucleotide
tgggcccgggggtgagtgca

SEQ ID NO: 7022 - DNA, 20 bp, Artificial Sequence
  Description of Artificial Sequence: Synthetic oligonucleotide
gggcccgggggtgagtgcac

SEQ ID NO: 7023 - DNA, 20 bp, Artificial Sequence
  Description of Artificial Sequence: Synthetic oligonucleotide
ggcccgggggtgagtgcaca

SEQ ID NO: 7024 - DNA, 20 bp, Artificial Sequence
  Description of Artificial Sequence: Synthetic oligonucleotide
gcccgggggtgagtgcacat

SEQ ID NO: 7025 - DNA, 20 bp, Artificial Sequence
  Description of Artificial Sequence: Synthetic oligonucleotide
cccgggggtgagtgcacatg

SEQ ID NO: 7026 - DNA, 20 bp, Artificial Sequence
  Description of Artificial Sequence: Synthetic oligonucleotide
ccgggggtgagtgcacatga

SEQ ID NO: 7027 - DNA, 20 bp, Artificial Sequence
  Description of Artificial Sequence: Synthetic oligonucleotide
cgggggtgagtgcacatgaa

SEQ ID NO: 7028 - DNA, 20 bp, Artificial Sequence
  Description of Artificial Sequence: Synthetic oligonucleotide
gggggtgagtgcacatgaag

SEQ ID NO: 7029 - DNA, 20 bp, Artificial Sequence
  Description of Artificial Sequence: Synthetic oligonucleotide
ggggtgagtgcacatgaagc

SEQ ID NO: 7030 - DNA, 20 bp, Artificial Sequence
  Description of Artificial Sequence: Synthetic oligonucleotide
gggtgagtgcacatgaagct

SEQ ID NO: 7031 - DNA, 20 bp, Artificial Sequence
  Description of Artificial Sequence: Synthetic oligonucleotide
ggtgagtgcacatgaagctt

SEQ ID NO: 7032 - DNA, 20 bp, Artificial Sequence
  Description of Artificial Sequence: Synthetic oligonucleotide
gtgagtgcacatgaagcttg

SEQ ID NO: 7033 - DNA, 20 bp, Artificial Sequence
  Description of Artificial Sequence: Synthetic oligonucleotide
tgagtgcacatgaagcttgg

SEQ ID NO: 7034 - DNA, 20 bp, Artificial Sequence
  Description of Artificial Sequence: Synthetic oligonucleotide
gagtgcacatgaagcttgga

SEQ ID NO: 7035 - DNA, 20 bp, Artificial Sequence
  Description of Artificial Sequence: Synthetic oligonucleotide
agtgcacatgaagcttggag

SEQ ID NO: 7036 - DNA, 20 bp, Artificial Sequence
  Description of Artificial Sequence: Synthetic oligonucleotide
gtgcacatgaagcttggagg

SEQ ID NO: 7037 - DNA, 20 bp, Artificial Sequence
  Description of Artificial Sequence: Synthetic oligonucleotide
tgcacatgaagcttggaggg

SEQ ID NO: 7038 - DNA, 20 bp, Artificial Sequence
  Description of Artificial Sequence: Synthetic oligonucleotide
gcacatgaagcttggaggga

SEQ ID NO: 7039 - DNA, 20 bp, Artificial Sequence
  Description of Artificial Sequence: Synthetic oligonucleotide
cacatgaagcttggagggaa

SEQ ID NO: 7040 - DNA, 20 bp, Artificial Sequence
  Description of Artificial Sequence: Synthetic oligonucleotide
acatgaagcttggagggaaa

SEQ ID NO: 7041 - DNA, 20 bp, Artificial Sequence
  Description of Artificial Sequence: Synthetic oligonucleotide
catgaagcttggagggaaaa

SEQ ID NO: 7042 - DNA, 20 bp, Artificial Sequence
  Description of Artificial Sequence: Synthetic oligonucleotide
atgaagcttggagggaaaaa

SEQ ID NO: 7043 - DNA, 20 bp, Artificial Sequence
  Description of Artificial Sequence: Synthetic oligonucleotide
tgaagcttggagggaaaaat

SEQ ID NO: 7044 - DNA, 20 bp, Artificial Sequence
  Description of Artificial Sequence: Synthetic oligonucleotide
gaagcttggagggaaaaatc

SEQ ID NO: 7045 - DNA, 20 bp, Artificial Sequence
  Description of Artificial Sequence: Synthetic oligonucleotide
aagcttggagggaaaaatcc

SEQ ID NO: 7046 - DNA, 20 bp, Artificial Sequence
  Description of Artificial Sequence: Synthetic oligonucleotide
agcttggagggaaaaatcca

SEQ ID NO: 7047 - DNA, 20 bp, Artificial Sequence
  Description of Artificial Sequence: Synthetic oligonucleotide
gcttggagggaaaaatccag

SEQ ID NO: 7048 - DNA, 20 bp, Artificial Sequence
  Description of Artificial Sequence: Synthetic oligonucleotide
cttggagggaaaaatccaga

SEQ ID NO: 7049 - DNA, 20 bp, Artificial Sequence
  Description of Artificial Sequence: Synthetic oligonucleotide
ttggagggaaaaatccagat

SEQ ID NO: 7050 - DNA, 20 bp, Artificial Sequence
  Description of Artificial Sequence: Synthetic oligonucleotide
tggagggaaaaatccagata

SEQ ID NO: 7051 - DNA, 20 bp, Artificial Sequence
  Description of Artificial Sequence: Synthetic oligonucleotide
ggagggaaaaatccagatac

SEQ ID NO: 7052 - DNA, 20 bp, Artificial Sequence
  Description of Artificial Sequence: Synthetic oligonucleotide
gagggaaaaatccagatact

SEQ ID NO: 7053 - DNA, 20 bp, Artificial Sequence
  Description of Artificial Sequence: Synthetic oligonucleotide
agggaaaaatccagatactt

SEQ ID NO: 7054 - DNA, 20 bp, Artificial Sequence
  Description of Artificial Sequence: Synthetic oligonucleotide
gggaaaaatccagatacttt

SEQ ID NO: 7055 - DNA, 20 bp, Artificial Sequence
  Description of Artificial Sequence: Synthetic oligonucleotide
ggaaaaatccagatactttt

SEQ ID NO: 7056 - DNA, 20 bp, Artificial Sequence
  Description of Artificial Sequence: Synthetic oligonucleotide
gaaaaatccagatacttttt

SEQ ID NO: 7057 - DNA, 20 bp, Artificial Sequence
  Description of Artificial Sequence: Synthetic oligonucleotide
aaaaatccagatactttttt

SEQ ID NO: 7058 - DNA, 20 bp, Artificial Sequence
  Description of Artificial Sequence: Synthetic oligonucleotide
aaaatccagatacttttttt

SEQ ID NO: 7059 - DNA, 20 bp, Artificial Sequence
  Description of Artificial Sequence: Synthetic oligonucleotide
aaatccagatactttttttt

SEQ ID NO: 7060 - DNA, 20 bp, Artificial Sequence
  Description of Artificial Sequence: Synthetic oligonucleotide
aatccagatacttttttttt

SEQ ID NO: 7061 - DNA, 20 bp, Artificial Sequence
  Description of Artificial Sequence: Synthetic oligonucleotide
atccagatactttttttttt

SEQ ID NO: 7062 - DNA, 20 bp, Artificial Sequence
  Description of Artificial Sequence: Synthetic oligonucleotide
tccagatacttttttttttt

SEQ ID NO: 7063 - DNA, 20 bp, Artificial Sequence
  Description of Artificial Sequence: Synthetic oligonucleotide
ccagatactttttttttttt

SEQ ID NO: 7064 - DNA, 20 bp, Artificial Sequence
  Description of Artificial Sequence: Synthetic oligonucleotide
cagatacttttttttttttt

SEQ ID NO: 7065 - DNA, 20 bp, Artificial Sequence
  Description of Artificial Sequence: Synthetic oligonucleotide
agatactttttttttttttg

SEQ ID NO: 7066 - DNA, 20 bp, Artificial Sequence
  Description of Artificial Sequence: Synthetic oligonucleotide
gatactttttttttttttga

SEQ ID NO: 7067 - DNA, 20 bp, Artificial Sequence
  Description of Artificial Sequence: Synthetic oligonucleotide
atactttttttttttttgaa

SEQ ID NO: 7068 - DNA, 20 bp, Artificial Sequence
  Description of Artificial Sequence: Synthetic oligonucleotide
tactttttttttttttgaag

SEQ ID NO: 7069 - DNA, 20 bp, Artificial Sequence
  Description of Artificial Sequence: Synthetic oligonucleotide
actttttttttttttgaagc

SEQ ID NO: 7070 - DNA, 20 bp, Artificial Sequence
  Description of Artificial Sequence: Synthetic oligonucleotide
ctttttttttttttgaagca

SEQ ID NO: 7071 - DNA, 20 bp, Artificial Sequence
  Description of Artificial Sequence: Synthetic oligonucleotide
tttttttttttttgaagcag

SEQ ID NO: 7072 - DNA, 20 bp, Artificial Sequence
  Description of Artificial Sequence: Synthetic oligonucleotide
ttttttttttttgaagcaga

SEQ ID NO: 7073 - DNA, 20 bp, Artificial Sequence
  Description of Artificial Sequence: Synthetic oligonucleotide
tttttttttttgaagcagaa

SEQ ID NO: 7074 - DNA, 20 bp, Artificial Sequence
  Description of Artificial Sequence: Synthetic oligonucleotide
ttttttttttgaagcagaat

SEQ ID NO: 7075 - DNA, 20 bp, Artificial Sequence
  Description of Artificial Sequence: Synthetic oligonucleotide
tttttttttgaagcagaatt

SEQ ID NO: 7076 - DNA, 20 bp, Artificial Sequence
  Description of Artificial Sequence: Synthetic oligonucleotide
ttttttttgaagcagaattt

SEQ ID NO: 7077 - DNA, 20 bp, Artificial Sequence
  Description of Artificial Sequence: Synthetic oligonucleotide
tttttttgaagcagaatttc

SEQ ID NO: 7078 - DNA, 20 bp, Artificial Sequence
  Description of Artificial Sequence: Synthetic oligonucleotide
ttttttgaagcagaatttca

SEQ ID NO: 7079 - DNA, 20 bp, Artificial Sequence
  Description of Artificial Sequence: Synthetic oligonucleotide
tttttgaagcagaatttcac

SEQ ID NO: 7080 - DNA, 20 bp, Artificial Sequence
  Description of Artificial Sequence: Synthetic oligonucleotide
ttttgaagcagaatttcact

SEQ ID NO: 7081 - DNA, 20 bp, Artificial Sequence
  Description of Artificial Sequence: Synthetic oligonucleotide
tttgaagcagaatttcactc

SEQ ID NO: 7082 - DNA, 20 bp, Artificial Sequence
  Description of Artificial Sequence: Synthetic oligonucleotide
ttgaagcagaatttcactct

SEQ ID NO: 7083 - DNA, 20 bp, Artificial Sequence
  Description of Artificial Sequence: Synthetic oligonucleotide
tgaagcagaatttcactctt

SEQ ID NO: 7084 - DNA, 20 bp, Artificial Sequence
  Description of Artificial Sequence: Synthetic oligonucleotide
gaagcagaatttcactcttg

SEQ ID NO: 7085 - DNA, 20 bp, Artificial Sequence
  Description of Artificial Sequence: Synthetic oligonucleotide
aagcagaatttcactcttgt

SEQ ID NO: 7086 - DNA, 20 bp, Artificial Sequence
  Description of Artificial Sequence: Synthetic oligonucleotide
agcagaatttcactcttgtt

SEQ ID NO: 7087 - DNA, 20 bp, Artificial Sequence
  Description of Artificial Sequence: Synthetic oligonucleotide
gcagaatttcactcttgttg

SEQ ID NO: 7088 - DNA, 20 bp, Artificial Sequence
  Description of Artificial Sequence: Synthetic oligonucleotide
cagaatttcactcttgttgc

SEQ ID NO: 7089 - DNA, 20 bp, Artificial Sequence
  Description of Artificial Sequence: Synthetic oligonucleotide
agaatttcactcttgttgcc

SEQ ID NO: 7090 - DNA, 20 bp, Artificial Sequence
  Description of Artificial Sequence: Synthetic oligonucleotide
gaatttcactcttgttgccc

SEQ ID NO: 7091 - DNA, 20 bp, Artificial Sequence
  Description of Artificial Sequence: Synthetic oligonucleotide
aatttcactcttgttgccca

SEQ ID NO: 7092 - DNA, 20 bp, Artificial Sequence
  Description of Artificial Sequence: Synthetic oligonucleotide
atttcactcttgttgcccag

SEQ ID NO: 7093 - DNA, 20 bp, Artificial Sequence
  Description of Artificial Sequence: Synthetic oligonucleotide
tttcactcttgttgcccagg

SEQ ID NO: 7094 - DNA, 20 bp, Artificial Sequence
  Description of Artificial Sequence: Synthetic oligonucleotide
ttcactcttgttgcccaggc

SEQ ID NO: 7095 - DNA, 20 bp, Artificial Sequence
  Description of Artificial Sequence: Synthetic oligonucleotide
tcactcttgttgcccaggct

SEQ ID NO: 7096 - DNA, 20 bp, Artificial Sequence
  Description of Artificial Sequence: Synthetic oligonucleotide
cactcttgttgcccaggcta

SEQ ID NO: 7097 - DNA, 20 bp, Artificial Sequence
  Description of Artificial Sequence: Synthetic oligonucleotide
actcttgttgcccaggctag

SEQ ID NO: 7098 - DNA, 20 bp, Artificial Sequence
  Description of Artificial Sequence: Synthetic oligonucleotide
ctcttgttgcccaggctaga

SEQ ID NO: 7099 - DNA, 20 bp, Artificial Sequence
  Description of Artificial Sequence: Synthetic oligonucleotide
tcttgttgcccaggctagag

SEQ ID NO: 7100 - DNA, 20 bp, Artificial Sequence
  Description of Artificial Sequence: Synthetic oligonucleotide
cttgttgcccaggctagagt

SEQ ID NO: 7101 - DNA, 20 bp, Artificial Sequence
  Description of Artificial Sequence: Synthetic oligonucleotide
ttgttgcccaggctagagta

SEQ ID NO: 7102 - DNA, 20 bp, Artificial Sequence
  Description of Artificial Sequence: Synthetic oligonucleotide
tgttgcccaggctagagtac

SEQ ID NO: 7103 - DNA, 20 bp, Artificial Sequence
  Description of Artificial Sequence: Synthetic oligonucleotide
gttgcccaggctagagtaca

SEQ ID NO: 7104 - DNA, 20 bp, Artificial Sequence
  Description of Artificial Sequence: Synthetic oligonucleotide
ttgcccaggctagagtacag

SEQ ID NO: 7105 - DNA, 20 bp, Artificial Sequence
  Description of Artificial Sequence: Synthetic oligonucleotide
tgcccaggctagagtacagt

SEQ ID NO: 7106 - DNA, 20 bp, Artificial Sequence
  Description of Artificial Sequence: Synthetic oligonucleotide
gcccaggctagagtacagtg

SEQ ID NO: 7107 - DNA, 20 bp, Artificial Sequence
  Description of Artificial Sequence: Synthetic oligonucleotide
cccaggctagagtacagtgg

SEQ ID NO: 7108 - DNA, 20 bp, Artificial Sequence
  Description of Artificial Sequence: Synthetic oligonucleotide
ccaggctagagtacagtggt

SEQ ID NO: 7109 - DNA, 20 bp, Artificial Sequence
  Description of Artificial Sequence: Synthetic oligonucleotide
caggctagagtacagtggtg

SEQ ID NO: 7110 - DNA, 20 bp, Artificial Sequence
  Description of Artificial Sequence: Synthetic oligonucleotide
aggctagagtacagtggtgc

SEQ ID NO: 7111 - DNA, 20 bp, Artificial Sequence
  Description of Artificial Sequence: Synthetic oligonucleotide
ggctagagtacagtggtgca

SEQ ID NO: 7112 - DNA, 20 bp, Artificial Sequence
  Description of Artificial Sequence: Synthetic oligonucleotide
gctagagtacagtggtgcaa

SEQ ID NO: 7113 - DNA, 20 bp, Artificial Sequence
  Description of Artificial Sequence: Synthetic oligonucleotide
ctagagtacagtggtgcaat

SEQ ID NO: 7114 - DNA, 20 bp, Artificial Sequence
  Description of Artificial Sequence: Synthetic oligonucleotide
tagagtacagtggtgcaatc

SEQ ID NO: 7115 - DNA, 20 bp, Artificial Sequence
  Description of Artificial Sequence: Synthetic oligonucleotide
agagtacagtggtgcaatct

SEQ ID NO: 7116 - DNA, 20 bp, Artificial Sequence
  Description of Artificial Sequence: Synthetic oligonucleotide
gagtacagtggtgcaatctc

SEQ ID NO: 7117 - DNA, 20 bp, Artificial Sequence
  Description of Artificial Sequence: Synthetic oligonucleotide
agtacagtggtgcaatctcg

SEQ ID NO: 7118 - DNA, 20 bp, Artificial Sequence
  Description of Artificial Sequence: Synthetic oligonucleotide
gtacagtggtgcaatctcgg

SEQ ID NO: 7119 - DNA, 20 bp, Artificial Sequence
  Description of Artificial Sequence: Synthetic oligonucleotide
tacagtggtgcaatctcggc

SEQ ID NO: 7120 - DNA, 20 bp, Artificial Sequence
  Description of Artificial Sequence: Synthetic oligonucleotide
acagtggtgcaatctcggct

SEQ ID NO: 7121 - DNA, 20 bp, Artificial Sequence
  Description of Artificial Sequence: Synthetic oligonucleotide
cagtggtgcaatctcggctc

SEQ ID NO: 7122 - DNA, 20 bp, Artificial Sequence
  Description of Artificial Sequence: Synthetic oligonucleotide
agtggtgcaatctcggctca

SEQ ID NO: 7123 - DNA, 20 bp, Artificial Sequence
  Description of Artificial Sequence: Synthetic oligonucleotide
gtggtgcaatctcggctcac

SEQ ID NO: 7124 - DNA, 20 bp, Artificial Sequence
  Description of Artificial Sequence: Synthetic oligonucleotide
tggtgcaatctcggctcact

SEQ ID NO: 7125 - DNA, 20 bp, Artificial Sequence
  Description of Artificial Sequence: Synthetic oligonucleotide
ggtgcaatctcggctcactg

SEQ ID NO: 7126 - DNA, 20 bp, Artificial Sequence
  Description of Artificial Sequence: Synthetic oligonucleotide
gtgcaatctcggctcactgc

SEQ ID NO: 7127 - DNA, 20 bp, Artificial Sequence
  Description of Artificial Sequence: Synthetic oligonucleotide
tgcaatctcggctcactgca

SEQ ID NO: 7128 - DNA, 20 bp, Artificial Sequence
  Description of Artificial Sequence: Synthetic oligonucleotide
gcaatctcggctcactgcaa

SEQ ID NO: 7129 - DNA, 20 bp, Artificial Sequence
  Description of Artificial Sequence: Synthetic oligonucleotide
caatctcggctcactgcaac

SEQ ID NO: 7130 - DNA, 20 bp, Artificial Sequence
  Description of Artificial Sequence: Synthetic oligonucleotide
aatctcggctcactgcaacc

SEQ ID NO: 7131 - DNA, 20 bp, Artificial Sequence
  Description of Artificial Sequence: Synthetic oligonucleotide
atctcggctcactgcaacct

SEQ ID NO: 7132 - DNA, 20 bp, Artificial Sequence
  Description of Artificial Sequence: Synthetic oligonucleotide
tctcggctcactgcaacctc

SEQ ID NO: 7133 - DNA, 20 bp, Artificial Sequence
  Description of Artificial Sequence: Synthetic oligonucleotide
ctcggctcactgcaacctcc

SEQ ID NO: 7134 - DNA, 20 bp, Artificial Sequence
  Description of Artificial Sequence: Synthetic oligonucleotide
tcggctcactgcaacctcca

SEQ ID NO: 7135 - DNA, 20 bp, Artificial Sequence
  Description of Artificial Sequence: Synthetic oligonucleotide
cggctcactgcaacctccac

SEQ ID NO: 7136 - DNA, 20 bp, Artificial Sequence
  Description of Artificial Sequence: Synthetic oligonucleotide
ggctcactgcaacctccacc

SEQ ID NO: 7137 - DNA, 20 bp, Artificial Sequence
  Description of Artificial Sequence: Synthetic oligonucleotide
gctcactgcaacctccacct

SEQ ID NO: 7138 - DNA, 20 bp, Artificial Sequence
  Description of Artificial Sequence: Synthetic oligonucleotide
ctcactgcaacctccacctc

SEQ ID NO: 7139 - DNA, 20 bp, Artificial Sequence
  Description of Artificial Sequence: Synthetic oligonucleotide
tcactgcaacctccacctcc

SEQ ID NO: 7140 - DNA, 20 bp, Artificial Sequence
  Description of Artificial Sequence: Synthetic oligonucleotide
cactgcaacctccacctcct

SEQ ID NO: 7141 - DNA, 20 bp, Artificial Sequence
  Description of Artificial Sequence: Synthetic oligonucleotide
actgcaacctccacctcctg

SEQ ID NO: 7142 - DNA, 20 bp, Artificial Sequence
  Description of Artificial Sequence: Synthetic oligonucleotide
ctgcaacctccacctcctga

SEQ ID NO: 7143 - DNA, 20 bp, Artificial Sequence
  Description of Artificial Sequence: Synthetic oligonucleotide
tgcaacctccacctcctgag

SEQ ID NO: 7144 - DNA, 20 bp, Artificial Sequence
  Description of Artificial Sequence: Synthetic oligonucleotide
gcaacctccacctcctgagt

SEQ ID NO: 7145 - DNA, 20 bp, Artificial Sequence
  Description of Artificial Sequence: Synthetic oligonucleotide
caacctccacctcctgagtt

SEQ ID NO: 7146 - DNA, 20 bp, Artificial Sequence
  Description of Artificial Sequence: Synthetic oligonucleotide
aacctccacctcctgagttc

SEQ ID NO: 7147 - DNA, 20 bp, Artificial Sequence
  Description of Artificial Sequence: Synthetic oligonucleotide
acctccacctcctgagttcc

SEQ ID NO: 7148 - DNA, 20 bp, Artificial Sequence
  Description of Artificial Sequence: Synthetic oligonucleotide
cctccacctcctgagttcca

SEQ ID NO: 7149 - DNA, 20 bp, Artificial Sequence
  Description of Artificial Sequence: Synthetic oligonucleotide
ctccacctcctgagttccag

SEQ ID NO: 7150 - DNA, 20 bp, Artificial Sequence
  Description of Artificial Sequence: Synthetic oligonucleotide
tccacctcctgagttccagt

SEQ ID NO: 7151 - DNA, 20 bp, Artificial Sequence
  Description of Artificial Sequence: Synthetic oligonucleotide
ccacctcctgagttccagtg

SEQ ID NO: 7152 - DNA, 20 bp, Artificial Sequence
  Description of Artificial Sequence: Synthetic oligonucleotide
cacctcctgagttccagtga

SEQ ID NO: 7153 - DNA, 20 bp, Artificial Sequence
  Description of Artificial Sequence: Synthetic oligonucleotide
acctcctgagttccagtgat

SEQ ID NO: 7154 - DNA, 20 bp, Artificial Sequence
  Description of Artificial Sequence: Synthetic oligonucleotide
cctcctgagttccagtgatt

SEQ ID NO: 7155 - DNA, 20 bp, Artificial Sequence
  Description of Artificial Sequence: Synthetic oligonucleotide
ctcctgagttccagtgattc

SEQ ID NO: 7156 - DNA, 20 bp, Artificial Sequence
  Description of Artificial Sequence: Synthetic oligonucleotide
tcctgagttccagtgattct

SEQ ID NO: 7157 - DNA, 20 bp, Artificial Sequence
  Description of Artificial Sequence: Synthetic oligonucleotide
cctgagttccagtgattctc

SEQ ID NO: 7158 - DNA, 20 bp, Artificial Sequence
  Description of Artificial Sequence: Synthetic oligonucleotide
ctgagttccagtgattctcc

SEQ ID NO: 7159 - DNA, 20 bp, Artificial Sequence
  Description of Artificial Sequence: Synthetic oligonucleotide
tgagttccagtgattctcct

SEQ ID NO: 7160 - DNA, 20 bp, Artificial Sequence
  Description of Artificial Sequence: Synthetic oligonucleotide
gagttccagtgattctcctg

SEQ ID NO: 7161 - DNA, 20 bp, Artificial Sequence
  Description of Artificial Sequence: Synthetic oligonucleotide
agttccagtgattctcctgc

SEQ ID NO: 7162 - DNA, 20 bp, Artificial Sequence
  Description of Artificial Sequence: Synthetic oligonucleotide
gttccagtgattctcctgcc

SEQ ID NO: 7163 - DNA, 20 bp, Artificial Sequence
  Description of Artificial Sequence: Synthetic oligonucleotide
ttccagtgattctcctgcct

SEQ ID NO: 7164 - DNA, 20 bp, Artificial Sequence
  Description of Artificial Sequence: Synthetic oligonucleotide
tccagtgattctcctgcctt

SEQ ID NO: 7165 - DNA, 20 bp, Artificial Sequence
  Description of Artificial Sequence: Synthetic oligonucleotide
ccagtgattctcctgccttc

SEQ ID NO: 7166 - DNA, 20 bp, Artificial Sequence
  Description of Artificial Sequence: Synthetic oligonucleotide
cagtgattctcctgccttcc

SEQ ID NO: 7167 - DNA, 20 bp, Artificial Sequence
  Description of Artificial Sequence: Synthetic oligonucleotide
agtgattctcctgccttcct

SEQ ID NO: 7168 - DNA, 20 bp, Artificial Sequence
  Description of Artificial Sequence: Synthetic oligonucleotide
gtgattctcctgccttccta

SEQ ID NO: 7169 - DNA, 20 bp, Artificial Sequence
  Description of Artificial Sequence: Synthetic oligonucleotide
tgattctcctgccttcctag

SEQ ID NO: 7170 - DNA, 20 bp, Artificial Sequence
  Description of Artificial Sequence: Synthetic oligonucleotide
gattctcctgccttcctagt

SEQ ID NO: 7171 - DNA, 20 bp, Artificial Sequence
  Description of Artificial Sequence: Synthetic oligonucleotide
attctcctgccttcctagta

SEQ ID NO: 7172 - DNA, 20 bp, Artificial Sequence
  Description of Artificial Sequence: Synthetic oligonucleotide
ttctcctgccttcctagtag

SEQ ID NO: 7173 - DNA, 20 bp, Artificial Sequence
  Description of Artificial Sequence: Synthetic oligonucleotide
tctcctgccttcctagtagc

SEQ ID NO: 7174 - DNA, 20 bp, Artificial Sequence
  Description of Artificial Sequence: Synthetic oligonucleotide
ctcctgccttcctagtagct

SEQ ID NO: 7175 - DNA, 20 bp, Artificial Sequence
  Description of Artificial Sequence: Synthetic oligonucleotide
tcctgccttcctagtagctg

SEQ ID NO: 7176 - DNA, 20 bp, Artificial Sequence
  Description of Artificial Sequence: Synthetic oligonucleotide
cctgccttcctagtagctgg

SEQ ID NO: 7177 - DNA, 20 bp, Artificial Sequence
  Description of Artificial Sequence: Synthetic oligonucleotide
ctgccttcctagtagctggg

SEQ ID NO: 7178 - DNA, 20 bp, Artificial Sequence
  Description of Artificial Sequence: Synthetic oligonucleotide
tgccttcctagtagctggga

SEQ ID NO: 7179 - DNA, 20 bp, Artificial Sequence
  Description of Artificial Sequence: Synthetic oligonucleotide
gccttcctagtagctgggac

SEQ ID NO: 7180 - DNA, 20 bp, Artificial Sequence
  Description of Artificial Sequence: Synthetic oligonucleotide
ccttcctagtagctgggacc

SEQ ID NO: 7181 - DNA, 20 bp, Artificial Sequence
  Description of Artificial Sequence: Synthetic oligonucleotide
cttcctagtagctgggacca

SEQ ID NO: 7182 - DNA, 20 bp, Artificial Sequence
  Description of Artificial Sequence: Synthetic oligonucleotide
ttcctagtagctgggaccag

SEQ ID NO: 7183 - DNA, 20 bp, Artificial Sequence
  Description of Artificial Sequence: Synthetic oligonucleotide
tcctagtagctgggaccaga

SEQ ID NO: 7184 - DNA, 20 bp, Artificial Sequence
  Description of Artificial Sequence: Synthetic oligonucleotide
cctagtagctgggaccagag

SEQ ID NO: 7185 - DNA, 20 bp, Artificial Sequence
  Description of Artificial Sequence: Synthetic oligonucleotide
ctagtagctgggaccagagt

SEQ ID NO: 7186 - DNA, 20 bp, Artificial Sequence
  Description of Artificial Sequence: Synthetic oligonucleotide
tagtagctgggaccagagtg

SEQ ID NO: 7187 - DNA, 20 bp, Artificial Sequence
  Description of Artificial Sequence: Synthetic oligonucleotide
agtagctgggaccagagtgc

SEQ ID NO: 7188 - DNA, 20 bp, Artificial Sequence
  Description of Artificial Sequence: Synthetic oligonucleotide
gtagctgggaccagagtgcc

SEQ ID NO: 7189 - DNA, 20 bp, Artificial Sequence
  Description of Artificial Sequence: Synthetic oligonucleotide
tagctgggaccagagtgcct

SEQ ID NO: 7190 - DNA, 20 bp, Artificial Sequence
  Description of Artificial Sequence: Synthetic oligonucleotide
agctgggaccagagtgcctg

SEQ ID NO: 7191 - DNA, 20 bp, Artificial Sequence
  Description of Artificial Sequence: Synthetic oligonucleotide
gctgggaccagagtgcctgt

SEQ ID NO: 7192 - DNA, 20 bp, Artificial Sequence
  Description of Artificial Sequence: Synthetic oligonucleotide
ctgggaccagagtgcctgtc

SEQ ID NO: 7193 - DNA, 20 bp, Artificial Sequence
  Description of Artificial Sequence: Synthetic oligonucleotide
tgggaccagagtgcctgtca

SEQ ID NO: 7194 - DNA, 20 bp, Artificial Sequence
  Description of Artificial Sequence: Synthetic oligonucleotide
gggaccagagtgcctgtcac

SEQ ID NO: 7195 - DNA, 20 bp, Artificial Sequence
  Description of Artificial Sequence: Synthetic oligonucleotide
ggaccagagtgcctgtcacc

SEQ ID NO: 7196 - DNA, 20 bp, Artificial Sequence
  Description of Artificial Sequence: Synthetic oligonucleotide
gaccagagtgcctgtcacca

SEQ ID NO: 7197 - DNA, 20 bp, Artificial Sequence
  Description of Artificial Sequence: Synthetic oligonucleotide
accagagtgcctgtcaccac

SEQ ID NO: 7198 - DNA, 20 bp, Artificial Sequence
  Description of Artificial Sequence: Synthetic oligonucleotide
ccagagtgcctgtcaccaca

SEQ ID NO: 7199 - DNA, 20 bp, Artificial Sequence
  Description of Artificial Sequence: Synthetic oligonucleotide
cagagtgcctgtcaccacac

SEQ ID NO: 7200 - DNA, 20 bp, Artificial Sequence
  Description of Artificial Sequence: Synthetic oligonucleotide
agagtgcctgtcaccacact

SEQ ID NO: 7201 - DNA, 20 bp, Artificial Sequence
  Description of Artificial Sequence: Synthetic oligonucleotide
gagtgcctgtcaccacactg

SEQ ID NO: 7202 - DNA, 20 bp, Artificial Sequence
  Description of Artificial Sequence: Synthetic oligonucleotide
agtgcctgtcaccacactgg

SEQ ID NO: 7203 - DNA, 20 bp, Artificial Sequence
  Description of Artificial Sequence: Synthetic oligonucleotide
gtgcctgtcaccacactggg

SEQ ID NO: 7204 - DNA, 20 bp, Artificial Sequence
  Description of Artificial Sequence: Synthetic oligonucleotide
tgcctgtcaccacactgggc

SEQ ID NO: 7205 - DNA, 20 bp, Artificial Sequence
  Description of Artificial Sequence: Synthetic oligonucleotide
gcctgtcaccacactgggct

SEQ ID NO: 7206 - DNA, 20 bp, Artificial Sequence
  Description of Artificial Sequence: Synthetic oligonucleotide
cctgtcaccacactgggcta

SEQ ID NO: 7207 - DNA, 20 bp, Artificial Sequence
  Description of Artificial Sequence: Synthetic oligonucleotide
ctgtcaccacactgggctaa

SEQ ID NO: 7208 - DNA, 20 bp, Artificial Sequence
  Description of Artificial Sequence: Synthetic oligonucleotide
tgtcaccacactgggctaat

SEQ ID NO: 7209 - DNA, 20 bp, Artificial Sequence
  Description of Artificial Sequence: Synthetic oligonucleotide
gtcaccacactgggctaatt

SEQ ID NO: 7210 - DNA, 20 bp, Artificial Sequence
  Description of Artificial Sequence: Synthetic oligonucleotide
tcaccacactgggctaattt

SEQ ID NO: 7211 - DNA, 20 bp, Artificial Sequence
  Description of Artificial Sequence: Synthetic oligonucleotide
caccacactgggctaatttt

SEQ ID NO: 7212 - DNA, 20 bp, Artificial Sequence
  Description of Artificial Sequence: Synthetic oligonucleotide
accacactgggctaattttt

SEQ ID NO: 7213 - DNA, 20 bp, Artificial Sequence
  Description of Artificial Sequence: Synthetic oligonucleotide
ccacactgggctaatttttg

SEQ ID NO: 7214 - DNA, 20 bp, Artificial Sequence
  Description of Artificial Sequence: Synthetic oligonucleotide
cacactgggctaatttttgt

SEQ ID NO: 7215 - DNA, 20 bp, Artificial Sequence
  Description of Artificial Sequence: Synthetic oligonucleotide
acactgggctaatttttgta

SEQ ID NO: 7216 - DNA, 20 bp, Artificial Sequence
  Description of Artificial Sequence: Synthetic oligonucleotide
cactgggctaatttttgtat

SEQ ID NO: 7217 - DNA, 20 bp, Artificial Sequence
  Description of Artificial Sequence: Synthetic oligonucleotide
actgggctaatttttgtatt

SEQ ID NO: 7218 - DNA, 20 bp, Artificial Sequence
  Description of Artificial Sequence: Synthetic oligonucleotide
ctgggctaatttttgtattt

SEQ ID NO: 7219 - DNA, 20 bp, Artificial Sequence
  Description of Artificial Sequence: Synthetic oligonucleotide
tgggctaatttttgtatttt

SEQ ID NO: 7220 - DNA, 20 bp, Artificial Sequence
  Description of Artificial Sequence: Synthetic oligonucleotide
gggctaatttttgtattttt

SEQ ID NO: 7221 - DNA, 20 bp, Artificial Sequence
  Description of Artificial Sequence: Synthetic oligonucleotide
ggctaatttttgtattttta

SEQ ID NO: 7222 - DNA, 20 bp, Artificial Sequence
  Description of Artificial Sequence: Synthetic oligonucleotide
gctaatttttgtatttttag

SEQ ID NO: 7223 - DNA, 20 bp, Artificial Sequence
  Description of Artificial Sequence: Synthetic oligonucleotide
ctaatttttgtatttttagt

SEQ ID NO: 7224 - DNA, 20 bp, Artificial Sequence
  Description of Artificial Sequence: Synthetic oligonucleotide
taatttttgtatttttagta

SEQ ID NO: 7225 - DNA, 20 bp, Artificial Sequence
  Description of Artificial Sequence: Synthetic oligonucleotide
aatttttgtatttttagtag

SEQ ID NO: 7226 - DNA, 20 bp, Artificial Sequence
  Description of Artificial Sequence: Synthetic oligonucleotide
atttttgtatttttagtaga

SEQ ID NO: 7227 - DNA, 20 bp, Artificial Sequence
  Description of Artificial Sequence: Synthetic oligonucleotide
tttttgtatttttagtagag

SEQ ID NO: 7228 - DNA, 20 bp, Artificial Sequence
  Description of Artificial Sequence: Synthetic oligonucleotide
ttttgtatttttagtagaga

SEQ ID NO: 7229 - DNA, 20 bp, Artificial Sequence
  Description of Artificial Sequence: Synthetic oligonucleotide
tttgtatttttagtagagac

SEQ ID NO: 7230 - DNA, 20 bp, Artificial Sequence
  Description of Artificial Sequence: Synthetic oligonucleotide
ttgtatttttagtagagact

SEQ ID NO: 7231 - DNA, 20 bp, Artificial Sequence
  Description of Artificial Sequence: Synthetic oligonucleotide
tgtatttttagtagagactg

SEQ ID NO: 7232 - DNA, 20 bp, Artificial Sequence
  Description of Artificial Sequence: Synthetic oligonucleotide
gtatttttagtagagactgg

SEQ ID NO: 7233 - DNA, 20 bp, Artificial Sequence
  Description of Artificial Sequence: Synthetic oligonucleotide
tatttttagtagagactggg

SEQ ID NO: 7234 - DNA, 20 bp, Artificial Sequence
  Description of Artificial Sequence: Synthetic oligonucleotide
atttttagtagagactgggt

SEQ ID NO: 7235 - DNA, 20 bp, Artificial Sequence
  Description of Artificial Sequence: Synthetic oligonucleotide
tttttagtagagactgggtt

SEQ ID NO: 7236 - DNA, 20 bp, Artificial Sequence
  Description of Artificial Sequence: Synthetic oligonucleotide
ttttagtagagactgggttt

SEQ ID NO: 7237 - DNA, 20 bp, Artificial Sequence
  Description of Artificial Sequence: Synthetic oligonucleotide
tttagtagagactgggtttc

SEQ ID NO: 7238 - DNA, 20 bp, Artificial Sequence
  Description of Artificial Sequence: Synthetic oligonucleotide
ttagtagagactgggtttca

SEQ ID NO: 7239 - DNA, 20 bp, Artificial Sequence
  Description of Artificial Sequence: Synthetic oligonucleotide
tagtagagactgggtttcag

SEQ ID NO: 7240 - DNA, 20 bp, Artificial Sequence
  Description of Artificial Sequence: Synthetic oligonucleotide
agtagagactgggtttcagc

SEQ ID NO: 7241 - DNA, 20 bp, Artificial Sequence
  Description of Artificial Sequence: Synthetic oligonucleotide
gtagagactgggtttcagca

SEQ ID NO: 7242 - DNA, 20 bp, Artificial Sequence
  Description of Artificial Sequence: Synthetic oligonucleotide
tagagactgggtttcagcat

SEQ ID NO: 7243 - DNA, 20 bp, Artificial Sequence
  Description of Artificial Sequence: Synthetic oligonucleotide
agagactgggtttcagcatg

SEQ ID NO: 7244 - DNA, 20 bp, Artificial Sequence
  Description of Artificial Sequence: Synthetic oligonucleotide
gagactgggtttcagcatgt

SEQ ID NO: 7245 - DNA, 20 bp, Artificial Sequence
  Description of Artificial Sequence: Synthetic oligonucleotide
agactgggtttcagcatgtt

SEQ ID NO: 7246 - DNA, 20 bp, Artificial Sequence
  Description of Artificial Sequence: Synthetic oligonucleotide
gactgggtttcagcatgttg

SEQ ID NO: 7247 - DNA, 20 bp, Artificial Sequence
  Description of Artificial Sequence: Synthetic oligonucleotide
actgggtttcagcatgttgg

SEQ ID NO: 7248 - DNA, 20 bp, Artificial Sequence
  Description of Artificial Sequence: Synthetic oligonucleotide
ctgggtttcagcatgttggc

SEQ ID NO: 7249 - DNA, 20 bp, Artificial Sequence
  Description of Artificial Sequence: Synthetic oligonucleotide
tgggtttcagcatgttggcc

SEQ ID NO: 7250 - DNA, 20 bp, Artificial Sequence
  Description of Artificial Sequence: Synthetic oligonucleotide
gggtttcagcatgttggcca

SEQ ID NO: 7251 - DNA, 20 bp, Artificial Sequence
  Description of Artificial Sequence: Synthetic oligonucleotide
ggtttcagcatgttggccag

SEQ ID NO: 7252 - DNA, 20 bp, Artificial Sequence
  Description of Artificial Sequence: Synthetic oligonucleotide
gtttcagcatgttggccagg

SEQ ID NO: 7253 - DNA, 20 bp, Artificial Sequence
  Description of Artificial Sequence: Synthetic oligonucleotide
tttcagcatgttggccaggc

SEQ ID NO: 7254 - DNA, 20 bp, Artificial Sequence
  Description of Artificial Sequence: Synthetic oligonucleotide
ttcagcatgttggccaggct

SEQ ID NO: 7255 - DNA, 20 bp, Artificial Sequence
  Description of Artificial Sequence: Synthetic oligonucleotide
tcagcatgttggccaggctg

SEQ ID NO: 7256 - DNA, 20 bp, Artificial Sequence
  Description of Artificial Sequence: Synthetic oligonucleotide
cagcatgttggccaggctgg

SEQ ID NO: 7257 - DNA, 20 bp, Artificial Sequence
  Description of Artificial Sequence: Synthetic oligonucleotide
agcatgttggccaggctggt

SEQ ID NO: 7258 - DNA, 20 bp, Artificial Sequence
  Description of Artificial Sequence: Synthetic oligonucleotide
gcatgttggccaggctggtc

SEQ ID NO: 7259 - DNA, 20 bp, Artificial Sequence
  Description of Artificial Sequence: Synthetic oligonucleotide
catgttggccaggctggtct

SEQ ID NO: 7260 - DNA, 20 bp, Artificial Sequence
  Description of Artificial Sequence: Synthetic oligonucleotide
atgttggccaggctggtctc

SEQ ID NO: 7261 - DNA, 20 bp, Artificial Sequence
  Description of Artificial Sequence: Synthetic oligonucleotide
tgttggccaggctggtctca

SEQ ID NO: 7262 - DNA, 20 bp, Artificial Sequence
  Description of Artificial Sequence: Synthetic oligonucleotide
gttggccaggctggtctcaa

SEQ ID NO: 7263 - DNA, 20 bp, Artificial Sequence
  Description of Artificial Sequence: Synthetic oligonucleotide
ttggccaggctggtctcaaa

SEQ ID NO: 7264 - DNA, 20 bp, Artificial Sequence
  Description of Artificial Sequence: Synthetic oligonucleotide
tggccaggctggtctcaaag

SEQ ID NO: 7265 - DNA, 20 bp, Artificial Sequence
  Description of Artificial Sequence: Synthetic oligonucleotide
ggccaggctggtctcaaagt

SEQ ID NO: 7266 - DNA, 20 bp, Artificial Sequence
  Description of Artificial Sequence: Synthetic oligonucleotide
gccaggctggtctcaaagtc

SEQ ID NO: 7267 - DNA, 20 bp, Artificial Sequence
  Description of Artificial Sequence: Synthetic oligonucleotide
ccaggctggtctcaaagtcc

SEQ ID NO: 7268 - DNA, 20 bp, Artificial Sequence
  Description of Artificial Sequence: Synthetic oligonucleotide
caggctggtctcaaagtcct

SEQ ID NO: 7269 - DNA, 20 bp, Artificial Sequence
  Description of Artificial Sequence: Synthetic oligonucleotide
aggctggtctcaaagtcctg

SEQ ID NO: 7270 - DNA, 20 bp, Artificial Sequence
  Description of Artificial Sequence: Synthetic oligonucleotide
ggctggtctcaaagtcctga

SEQ ID NO: 7271 - DNA, 20 bp, Artificial Sequence
  Description of Artificial Sequence: Synthetic oligonucleotide
gctggtctcaaagtcctgac

SEQ ID NO: 7272 - DNA, 20 bp, Artificial Sequence
  Description of Artificial Sequence: Synthetic oligonucleotide
ctggtctcaaagtcctgacc

SEQ ID NO: 7273 - DNA, 20 bp, Artificial Sequence
  Description of Artificial Sequence: Synthetic oligonucleotide
tggtctcaaagtcctgacct

SEQ ID NO: 7274 - DNA, 20 bp, Artificial Sequence
  Description of Artificial Sequence: Synthetic oligonucleotide
ggtctcaaagtcctgacctc

SEQ ID NO: 7275 - DNA, 20 bp, Artificial Sequence
  Description of Artificial Sequence: Synthetic oligonucleotide
gtctcaaagtcctgacctca

SEQ ID NO: 7276 - DNA, 20 bp, Artificial Sequence
  Description of Artificial Sequence: Synthetic oligonucleotide
tctcaaagtcctgacctcag

SEQ ID NO: 7277 - DNA, 20 bp, Artificial Sequence
  Description of Artificial Sequence: Synthetic oligonucleotide
ctcaaagtcctgacctcagg

SEQ ID NO: 7278 - DNA, 20 bp, Artificial Sequence
  Description of Artificial Sequence: Synthetic oligonucleotide
tcaaagtcctgacctcaggt

SEQ ID NO: 7279 - DNA, 20 bp, Artificial Sequence
  Description of Artificial Sequence: Synthetic oligonucleotide
caaagtcctgacctcaggtg

SEQ ID NO: 7280 - DNA, 20 bp, Artificial Sequence
  Description of Artificial Sequence: Synthetic oligonucleotide
aaagtcctgacctcaggtga

SEQ ID NO: 7281 - DNA, 20 bp, Artificial Sequence
  Description of Artificial Sequence: Synthetic oligonucleotide
aagtcctgacctcaggtgat

SEQ ID NO: 7282 - DNA, 20 bp, Artificial Sequence
  Description of Artificial Sequence: Synthetic oligonucleotide
agtcctgacctcaggtgatt

SEQ ID NO: 7283 - DNA, 20 bp, Artificial Sequence
  Description of Artificial Sequence: Synthetic oligonucleotide
gtcctgacctcaggtgattg

SEQ ID NO: 7284 - DNA, 20 bp, Artificial Sequence
  Description of Artificial Sequence: Synthetic oligonucleotide
tcctgacctcaggtgattgt

SEQ ID NO: 7285 - DNA, 20 bp, Artificial Sequence
  Description of Artificial Sequence: Synthetic oligonucleotide
cctgacctcaggtgattgtt

SEQ ID NO: 7286 - DNA, 20 bp, Artificial Sequence
  Description of Artificial Sequence: Synthetic oligonucleotide
ctgacctcaggtgattgttc

SEQ ID NO: 7287 - DNA, 20 bp, Artificial Sequence
  Description of Artificial Sequence: Synthetic oligonucleotide
tgacctcaggtgattgttcc

SEQ ID NO: 7288 - DNA, 20 bp, Artificial Sequence
  Description of Artificial Sequence: Synthetic oligonucleotide
gacctcaggtgattgttccg

SEQ ID NO: 7289 - DNA, 20 bp, Artificial Sequence
  Description of Artificial Sequence: Synthetic oligonucleotide
acctcaggtgattgttccgc

SEQ ID NO: 7290 - DNA, 20 bp, Artificial Sequence
  Description of Artificial Sequence: Synthetic oligonucleotide
cctcaggtgattgttccgcc

SEQ ID NO: 7291 - DNA, 20 bp, Artificial Sequence
  Description of Artificial Sequence: Synthetic oligonucleotide
ctcaggtgattgttccgccc

SEQ ID NO: 7292 - DNA, 20 bp, Artificial Sequence
  Description of Artificial Sequence: Synthetic oligonucleotide
tcaggtgattgttccgccca

SEQ ID NO: 7293 - DNA, 20 bp, Artificial Sequence
  Description of Artificial Sequence: Synthetic oligonucleotide
caggtgattgttccgcccac

SEQ ID NO: 7294 - DNA, 20 bp, Artificial Sequence
  Description of Artificial Sequence: Synthetic oligonucleotide
aggtgattgttccgcccacc

SEQ ID NO: 7295 - DNA, 20 bp, Artificial Sequence
  Description of Artificial Sequence: Synthetic oligonucleotide
ggtgattgttccgcccacct

SEQ ID NO: 7296 - DNA, 20 bp, Artificial Sequence
  Description of Artificial Sequence: Synthetic oligonucleotide
gtgattgttccgcccacctc

SEQ ID NO: 7297 - DNA, 20 bp, Artificial Sequence
  Description of Artificial Sequence: Synthetic oligonucleotide
tgattgttccgcccacctca

SEQ ID NO: 7298 - DNA, 20 bp, Artificial Sequence
  Description of Artificial Sequence: Synthetic oligonucleotide
gattgttccgcccacctcac

SEQ ID NO: 7299 - DNA, 20 bp, Artificial Sequence
  Description of Artificial Sequence: Synthetic oligonucleotide
attgttccgcccacctcacc

SEQ ID NO: 7300 - DNA, 20 bp, Artificial Sequence
  Description of Artificial Sequence: Synthetic oligonucleotide
ttgttccgcccacctcacct

SEQ ID NO: 7301 - DNA, 20 bp, Artificial Sequence
  Description of Artificial Sequence: Synthetic oligonucleotide
tgttccgcccacctcacctc

SEQ ID NO: 7302 - DNA, 20 bp, Artificial Sequence
  Description of Artificial Sequence: Synthetic oligonucleotide
gttccgcccacctcacctcc

SEQ ID NO: 7303 - DNA, 20 bp, Artificial Sequence
  Description of Artificial Sequence: Synthetic oligonucleotide
ttccgcccacctcacctccc

SEQ ID NO: 7304 - DNA, 20 bp, Artificial Sequence
  Description of Artificial Sequence: Synthetic oligonucleotide
tccgcccacctcacctccca

SEQ ID NO: 7305 - DNA, 20 bp, Artificial Sequence
  Description of Artificial Sequence: Synthetic oligonucleotide
ccgcccacctcacctcccaa

SEQ ID NO: 7306 - DNA, 20 bp, Artificial Sequence
  Description of Artificial Sequence: Synthetic oligonucleotide
cgcccacctcacctcccaaa

SEQ ID NO: 7307 - DNA, 20 bp, Artificial Sequence
  Description of Artificial Sequence: Synthetic oligonucleotide
gcccacctcacctcccaaaa

SEQ ID NO: 7308 - DNA, 20 bp, Artificial Sequence
  Description of Artificial Sequence: Synthetic oligonucleotide
cccacctcacctcccaaaaa

SEQ ID NO: 7309 - DNA, 20 bp, Artificial Sequence
  Description of Artificial Sequence: Synthetic oligonucleotide
ccacctcacctcccaaaaaa

SEQ ID NO: 7310 - DNA, 20 bp, Artificial Sequence
  Description of Artificial Sequence: Synthetic oligonucleotide
cacctcacctcccaaaaaac

SEQ ID NO: 7311 - DNA, 20 bp, Artificial Sequence
  Description of Artificial Sequence: Synthetic oligonucleotide
acctcacctcccaaaaaact

SEQ ID NO: 7312 - DNA, 20 bp, Artificial Sequence
  Description of Artificial Sequence: Synthetic oligonucleotide
cctcacctcccaaaaaactt

SEQ ID NO: 7313 - DNA, 20 bp, Artificial Sequence
  Description of Artificial Sequence: Synthetic oligonucleotide
ctcacctcccaaaaaacttg

SEQ ID NO: 7314 - DNA, 20 bp, Artificial Sequence
  Description of Artificial Sequence: Synthetic oligonucleotide
tcacctcccaaaaaacttgg

SEQ ID NO: 7315 - DNA, 20 bp, Artificial Sequence
  Description of Artificial Sequence: Synthetic oligonucleotide
cacctcccaaaaaacttggg

SEQ ID NO: 7316 - DNA, 20 bp, Artificial Sequence
  Description of Artificial Sequence: Synthetic oligonucleotide
acctcccaaaaaacttggga

SEQ ID NO: 7317 - DNA, 20 bp, Artificial Sequence
  Description of Artificial Sequence: Synthetic oligonucleotide
cctcccaaaaaacttgggat

SEQ ID NO: 7318 - DNA, 20 bp, Artificial Sequence
  Description of Artificial Sequence: Synthetic oligonucleotide
ctcccaaaaaacttgggatt

SEQ ID NO: 7319 - DNA, 20 bp, Artificial Sequence
  Description of Artificial Sequence: Synthetic oligonucleotide
tcccaaaaaacttgggatta

SEQ ID NO: 7320 - DNA, 20 bp, Artificial Sequence
  Description of Artificial Sequence: Synthetic oligonucleotide
cccaaaaaacttgggattac

SEQ ID NO: 7321 - DNA, 20 bp, Artificial Sequence
  Description of Artificial Sequence: Synthetic oligonucleotide
ccaaaaaacttgggattaca

SEQ ID NO: 7322 - DNA, 20 bp, Artificial Sequence
  Description of Artificial Sequence: Synthetic oligonucleotide
caaaaaacttgggattacag

SEQ ID NO: 7323 - DNA, 20 bp, Artificial Sequence
  Description of Artificial Sequence: Synthetic oligonucleotide
aaaaaacttgggattacagg

SEQ ID NO: 7324 - DNA, 20 bp, Artificial Sequence
  Description of Artificial Sequence: Synthetic oligonucleotide
aaaaacttgggattacaggt

SEQ ID NO: 7325 - DNA, 20 bp, Artificial Sequence
  Description of Artificial Sequence: Synthetic oligonucleotide
aaaacttgggattacaggtg

SEQ ID NO: 7326 - DNA, 20 bp, Artificial Sequence
  Description of Artificial Sequence: Synthetic oligonucleotide
aaacttgggattacaggtgt

SEQ ID NO: 7327 - DNA, 20 bp, Artificial Sequence
  Description of Artificial Sequence: Synthetic oligonucleotide
aacttgggattacaggtgtg

SEQ ID NO: 7328 - DNA, 20 bp, Artificial Sequence
  Description of Artificial Sequence: Synthetic oligonucleotide
acttgggattacaggtgtga

SEQ ID NO: 7329 - DNA, 20 bp, Artificial Sequence
  Description of Artificial Sequence: Synthetic oligonucleotide
cttgggattacaggtgtgag

SEQ ID NO: 7330 - DNA, 20 bp, Artificial Sequence
  Description of Artificial Sequence: Synthetic oligonucleotide
ttgggattacaggtgtgagc

SEQ ID NO: 7331 - DNA, 20 bp, Artificial Sequence
  Description of Artificial Sequence: Synthetic oligonucleotide
tgggattacaggtgtgagcc

SEQ ID NO: 7332 - DNA, 20 bp, Artificial Sequence
  Description of Artificial Sequence: Synthetic oligonucleotide
gggattacaggtgtgagcca

SEQ ID NO: 7333 - DNA, 20 bp, Artificial Sequence
  Description of Artificial Sequence: Synthetic oligonucleotide
ggattacaggtgtgagccac

SEQ ID NO: 7334 - DNA, 20 bp, Artificial Sequence
  Description of Artificial Sequence: Synthetic oligonucleotide
gattacaggtgtgagccacc

SEQ ID NO: 7335 - DNA, 20 bp, Artificial Sequence
  Description of Artificial Sequence: Synthetic oligonucleotide
attacaggtgtgagccacca

SEQ ID NO: 7336 - DNA, 20 bp, Artificial Sequence
  Description of Artificial Sequence: Synthetic oligonucleotide
ttacaggtgtgagccaccat

SEQ ID NO: 7337 - DNA, 20 bp, Artificial Sequence
  Description of Artificial Sequence: Synthetic oligonucleotide
tacaggtgtgagccaccatg

SEQ ID NO: 7338 - DNA, 20 bp, Artificial Sequence
  Description of Artificial Sequence: Synthetic oligonucleotide
acaggtgtgagccaccatgc

SEQ ID NO: 7339 - DNA, 20 bp, Artificial Sequence
  Description of Artificial Sequence: Synthetic oligonucleotide
caggtgtgagccaccatgcc

SEQ ID NO: 7340 - DNA, 20 bp, Artificial Sequence
  Description of Artificial Sequence: Synthetic oligonucleotide
aggtgtgagccaccatgcct

SEQ ID NO: 7341 - DNA, 20 bp, Artificial Sequence
  Description of Artificial Sequence: Synthetic oligonucleotide
ggtgtgagccaccatgcctg

SEQ ID NO: 7342 - DNA, 20 bp, Artificial Sequence
  Description of Artificial Sequence: Synthetic oligonucleotide
gtgtgagccaccatgcctgg

SEQ ID NO: 7343 - DNA, 20 bp, Artificial Sequence
  Description of Artificial Sequence: Synthetic oligonucleotide
tgtgagccaccatgcctggg

SEQ ID NO: 7344 - DNA, 20 bp, Artificial Sequence
  Description of Artificial Sequence: Synthetic oligonucleotide
gtgagccaccatgcctgggt

SEQ ID NO: 7345 - DNA, 20 bp, Artificial Sequence
  Description of Artificial Sequence: Synthetic oligonucleotide
tgagccaccatgcctgggtg

SEQ ID NO: 7346 - DNA, 20 bp, Artificial Sequence
  Description of Artificial Sequence: Synthetic oligonucleotide
gagccaccatgcctgggtga

SEQ ID NO: 7347 - DNA, 20 bp, Artificial Sequence
  Description of Artificial Sequence: Synthetic oligonucleotide
agccaccatgcctgggtgaa

SEQ ID NO: 7348 - DNA, 20 bp, Artificial Sequence
  Description of Artificial Sequence: Synthetic oligonucleotide
gccaccatgcctgggtgaaa

SEQ ID NO: 7349 - DNA, 20 bp, Artificial Sequence
  Description of Artificial Sequence: Synthetic oligonucleotide
ccaccatgcctgggtgaaaa

SEQ ID NO: 7350 - DNA, 20 bp, Artificial Sequence
  Description of Artificial Sequence: Synthetic oligonucleotide
caccatgcctgggtgaaaat

SEQ ID NO: 7351 - DNA, 20 bp, Artificial Sequence
  Description of Artificial Sequence: Synthetic oligonucleotide
accatgcctgggtgaaaatc

SEQ ID NO: 7352 - DNA, 20 bp, Artificial Sequence
  Description of Artificial Sequence: Synthetic oligonucleotide
ccatgcctgggtgaaaatcc

SEQ ID NO: 7353 - DNA, 20 bp, Artificial Sequence
  Description of Artificial Sequence: Synthetic oligonucleotide
catgcctgggtgaaaatcca

SEQ ID NO: 7354 - DNA, 20 bp, Artificial Sequence
  Description of Artificial Sequence: Synthetic oligonucleotide
atgcctgggtgaaaatccag

SEQ ID NO: 7355 - DNA, 20 bp, Artificial Sequence
  Description of Artificial Sequence: Synthetic oligonucleotide
tgcctgggtgaaaatccaga

SEQ ID NO: 7356 - DNA, 20 bp, Artificial Sequence
  Description of Artificial Sequence: Synthetic oligonucleotide
gcctgggtgaaaatccagat

SEQ ID NO: 7357 - DNA, 20 bp, Artificial Sequence
  Description of Artificial Sequence: Synthetic oligonucleotide
cctgggtgaaaatccagata

SEQ ID NO: 7358 - DNA, 20 bp, Artificial Sequence
  Description of Artificial Sequence: Synthetic oligonucleotide
ctgggtgaaaatccagataa

SEQ ID NO: 7359 - DNA, 20 bp, Artificial Sequence
  Description of Artificial Sequence: Synthetic oligonucleotide
tgggtgaaaatccagataat

SEQ ID NO: 7360 - DNA, 20 bp, Artificial Sequence
  Description of Artificial Sequence: Synthetic oligonucleotide
gggtgaaaatccagataatt

SEQ ID NO: 7361 - DNA, 20 bp, Artificial Sequence
  Description of Artificial Sequence: Synthetic oligonucleotide
ggtgaaaatccagataattt

SEQ ID NO: 7362 - DNA, 20 bp, Artificial Sequence
  Description of Artificial Sequence: Synthetic oligonucleotide
gtgaaaatccagataatttg

SEQ ID NO: 7363 - DNA, 20 bp, Artificial Sequence
  Description of Artificial Sequence: Synthetic oligonucleotide
tgaaaatccagataatttga

SEQ ID NO: 7364 - DNA, 20 bp, Artificial Sequence
  Description of Artificial Sequence: Synthetic oligonucleotide
gaaaatccagataatttgat

SEQ ID NO: 7365 - DNA, 20 bp, Artificial Sequence
  Description of Artificial Sequence: Synthetic oligonucleotide
aaaatccagataatttgatg

SEQ ID NO: 7366 - DNA, 20 bp, Artificial Sequence
  Description of Artificial Sequence: Synthetic oligonucleotide
aaatccagataatttgatgc

SEQ ID NO: 7367 - DNA, 20 bp, Artificial Sequence
  Description of Artificial Sequence: Synthetic oligonucleotide
aatccagataatttgatgct

SEQ ID NO: 7368 - DNA, 20 bp, Artificial Sequence
  Description of Artificial Sequence: Synthetic oligonucleotide
atccagataatttgatgctg

SEQ ID NO: 7369 - DNA, 20 bp, Artificial Sequence
  Description of Artificial Sequence: Synthetic oligonucleotide
tccagataatttgatgctgc

SEQ ID NO: 7370 - DNA, 20 bp, Artificial Sequence
  Description of Artificial Sequence: Synthetic oligonucleotide
ccagataatttgatgctgcc

SEQ ID NO: 7371 - DNA, 20 bp, Artificial Sequence
  Description of Artificial Sequence: Synthetic oligonucleotide
cagataatttgatgctgcct

SEQ ID NO: 7372 - DNA, 20 bp, Artificial Sequence
  Description of Artificial Sequence: Synthetic oligonucleotide
agataatttgatgctgcctt

SEQ ID NO: 7373 - DNA, 20 bp, Artificial Sequence
  Description of Artificial Sequence: Synthetic oligonucleotide
gataatttgatgctgccttc

SEQ ID NO: 7374 - DNA, 20 bp, Artificial Sequence
  Description of Artificial Sequence: Synthetic oligonucleotide
ataatttgatgctgccttcg

SEQ ID NO: 7375 - DNA, 20 bp, Artificial Sequence
  Description of Artificial Sequence: Synthetic oligonucleotide
taatttgatgctgccttcgt

SEQ ID NO: 7376 - DNA, 20 bp, Artificial Sequence
  Description of Artificial Sequence: Synthetic oligonucleotide
aatttgatgctgccttcgtg

SEQ ID NO: 7377 - DNA, 20 bp, Artificial Sequence
  Description of Artificial Sequence: Synthetic oligonucleotide
atttgatgctgccttcgtgt

SEQ ID NO: 7378 - DNA, 20 bp, Artificial Sequence
  Description of Artificial Sequence: Synthetic oligonucleotide
tttgatgctgccttcgtgtt

SEQ ID NO: 7379 - DNA, 20 bp, Artificial Sequence
  Description of Artificial Sequence: Synthetic oligonucleotide
ttgatgctgccttcgtgttt

SEQ ID NO: 7380 - DNA, 20 bp, Artificial Sequence
  Description of Artificial Sequence: Synthetic oligonucleotide
tgatgctgccttcgtgtttt

SEQ ID NO: 7381 - DNA, 20 bp, Artificial Sequence
  Description of Artificial Sequence: Synthetic oligonucleotide
gatgctgccttcgtgttttc

SEQ ID NO: 7382 - DNA, 20 bp, Artificial Sequence
  Description of Artificial Sequence: Synthetic oligonucleotide
atgctgccttcgtgttttct

SEQ ID NO: 7383 - DNA, 20 bp, Artificial Sequence
  Description of Artificial Sequence: Synthetic oligonucleotide
tgctgccttcgtgttttctt

SEQ ID NO: 7384 - DNA, 20 bp, Artificial Sequence
  Description of Artificial Sequence: Synthetic oligonucleotide
gctgccttcgtgttttcttt

SEQ ID NO: 7385 - DNA, 20 bp, Artificial Sequence
  Description of Artificial Sequence: Synthetic oligonucleotide
ctgccttcgtgttttctttt

SEQ ID NO: 7386 - DNA, 20 bp, Artificial Sequence
  Description of Artificial Sequence: Synthetic oligonucleotide
tgccttcgtgttttcttttc

SEQ ID NO: 7387 - DNA, 20 bp, Artificial Sequence
  Description of Artificial Sequence: Synthetic oligonucleotide
gccttcgtgttttcttttct

SEQ ID NO: 7388 - DNA, 20 bp, Artificial Sequence
  Description of Artificial Sequence: Synthetic oligonucleotide
ccttcgtgttttcttttctc

SEQ ID NO: 7389 - DNA, 20 bp, Artificial Sequence
  Description of Artificial Sequence: Synthetic oligonucleotide
cttcgtgttttcttttctcc

SEQ ID NO: 7390 - DNA, 20 bp, Artificial Sequence
  Description of Artificial Sequence: Synthetic oligonucleotide
ttcgtgttttcttttctcct

SEQ ID NO: 7391 - DNA, 20 bp, Artificial Sequence
  Description of Artificial Sequence: Synthetic oligonucleotide
tcgtgttttcttttctcctc

SEQ ID NO: 7392 - DNA, 20 bp, Artificial Sequence
  Description of Artificial Sequence: Synthetic oligonucleotide
cgtgttttcttttctcctcc

SEQ ID NO: 7393 - DNA, 20 bp, Artificial Sequence
  Description of Artificial Sequence: Synthetic oligonucleotide
gtgttttcttttctcctccc

SEQ ID NO: 7394 - DNA, 20 bp, Artificial Sequence
  Description of Artificial Sequence: Synthetic oligonucleotide
tgttttcttttctcctcccc

SEQ ID NO: 7395 - DNA, 20 bp, Artificial Sequence
  Description of Artificial Sequence: Synthetic oligonucleotide
gttttcttttctcctccccc

SEQ ID NO: 7396 - DNA, 20 bp, Artificial Sequence
  Description of Artificial Sequence: Synthetic oligonucleotide
ttttcttttctcctccccca

SEQ ID NO: 7397 - DNA, 20 bp, Artificial Sequence
  Description of Artificial Sequence: Synthetic oligonucleotide
tttcttttctcctcccccaa

SEQ ID NO: 7398 - DNA, 20 bp, Artificial Sequence
  Description of Artificial Sequence: Synthetic oligonucleotide
ttcttttctcctcccccaag

SEQ ID NO: 7399 - DNA, 20 bp, Artificial Sequence
  Description of Artificial Sequence: Synthetic oligonucleotide
tcttttctcctcccccaagg

SEQ ID NO: 7400 - DNA, 20 bp, Artificial Sequence
  Description of Artificial Sequence: Synthetic oligonucleotide
cttttctcctcccccaagga

SEQ ID NO: 7401 - DNA, 20 bp, Artificial Sequence
  Description of Artificial Sequence: Synthetic oligonucleotide
ttttctcctcccccaaggaa

SEQ ID NO: 7402 - DNA, 20 bp, Artificial Sequence
  Description of Artificial Sequence: Synthetic oligonucleotide
tttctcctcccccaaggaat

SEQ ID NO: 7403 - DNA, 20 bp, Artificial Sequence
  Description of Artificial Sequence: Synthetic oligonucleotide
ttctcctcccccaaggaata

SEQ ID NO: 7404 - DNA, 20 bp, Artificial Sequence
  Description of Artificial Sequence: Synthetic oligonucleotide
tctcctcccccaaggaatag

SEQ ID NO: 7405 - DNA, 20 bp, Artificial Sequence
  Description of Artificial Sequence: Synthetic oligonucleotide
ctcctcccccaaggaatagc

SEQ ID NO: 7406 - DNA, 20 bp, Artificial Sequence
  Description of Artificial Sequence: Synthetic oligonucleotide
tcctcccccaaggaatagct

SEQ ID NO: 7407 - DNA, 20 bp, Artificial Sequence
  Description of Artificial Sequence: Synthetic oligonucleotide
cctcccccaaggaatagctg

SEQ ID NO: 7408 - DNA, 20 bp, Artificial Sequence
  Description of Artificial Sequence: Synthetic oligonucleotide
ctcccccaaggaatagctgt

SEQ ID NO: 7409 - DNA, 20 bp, Artificial Sequence
  Description of Artificial Sequence: Synthetic oligonucleotide
tcccccaaggaatagctgtt

SEQ ID NO: 7410 - DNA, 20 bp, Artificial Sequence
  Description of Artificial Sequence: Synthetic oligonucleotide
cccccaaggaatagctgttc

SEQ ID NO: 7411 - DNA, 20 bp, Artificial Sequence
  Description of Artificial Sequence: Synthetic oligonucleotide
ccccaaggaatagctgttct

SEQ ID NO: 7412 - DNA, 20 bp, Artificial Sequence
  Description of Artificial Sequence: Synthetic oligonucleotide
cccaaggaatagctgttcta

SEQ ID NO: 7413 - DNA, 20 bp, Artificial Sequence
  Description of Artificial Sequence: Synthetic oligonucleotide
ccaaggaatagctgttctag

SEQ ID NO: 7414 - DNA, 20 bp, Artificial Sequence
  Description of Artificial Sequence: Synthetic oligonucleotide
caaggaatagctgttctagg

SEQ ID NO: 7415 - DNA, 20 bp, Artificial Sequence
  Description of Artificial Sequence: Synthetic oligonucleotide
aaggaatagctgttctagga

SEQ ID NO: 7416 - DNA, 20 bp, Artificial Sequence
  Description of Artificial Sequence: Synthetic oligonucleotide
aggaatagctgttctaggac

SEQ ID NO: 7417 - DNA, 20 bp, Artificial Sequence
  Description of Artificial Sequence: Synthetic oligonucleotide
ggaatagctgttctaggaca

SEQ ID NO: 7418 - DNA, 20 bp, Artificial Sequence
  Description of Artificial Sequence: Synthetic oligonucleotide
gaatagctgttctaggacat

SEQ ID NO: 7419 - DNA, 20 bp, Artificial Sequence
  Description of Artificial Sequence: Synthetic oligonucleotide
aatagctgttctaggacatg

SEQ ID NO: 7420 - DNA, 20 bp, Artificial Sequence
  Description of Artificial Sequence: Synthetic oligonucleotide
atagctgttctaggacatgg

SEQ ID NO: 7421 - DNA, 20 bp, Artificial Sequence
  Description of Artificial Sequence: Synthetic oligonucleotide
tagctgttctaggacatggc

SEQ ID NO: 7422 - DNA, 20 bp, Artificial Sequence
  Description of Artificial Sequence: Synthetic oligonucleotide
agctgttctaggacatggca

SEQ ID NO: 7423 - DNA, 20 bp, Artificial Sequence
  Description of Artificial Sequence: Synthetic oligonucleotide
gctgttctaggacatggcaa

SEQ ID NO: 7424 - DNA, 20 bp, Artificial Sequence
  Description of Artificial Sequence: Synthetic oligonucleotide
ctgttctaggacatggcaag

SEQ ID NO: 7425 - DNA, 20 bp, Artificial Sequence
  Description of Artificial Sequence: Synthetic oligonucleotide
tgttctaggacatggcaaga

SEQ ID NO: 7426 - DNA, 20 bp, Artificial Sequence
  Description of Artificial Sequence: Synthetic oligonucleotide
gttctaggacatggcaagag

SEQ ID NO: 7427 - DNA, 20 bp, Artificial Sequence
  Description of Artificial Sequence: Synthetic oligonucleotide
ttctaggacatggcaagaga

SEQ ID NO: 7428 - DNA, 20 bp, Artificial Sequence
  Description of Artificial Sequence: Synthetic oligonucleotide
tctaggacatggcaagagat

SEQ ID NO: 7429 - DNA, 20 bp, Artificial Sequence
  Description of Artificial Sequence: Synthetic oligonucleotide
ctaggacatggcaagagatt

SEQ ID NO: 7430 - DNA, 20 bp, Artificial Sequence
  Description of Artificial Sequence: Synthetic oligonucleotide
taggacatggcaagagattt

SEQ ID NO: 7431 - DNA, 20 bp, Artificial Sequence
  Description of Artificial Sequence: Synthetic oligonucleotide
aggacatggcaagagattta

SEQ ID NO: 7432 - DNA, 20 bp, Artificial Sequence
  Description of Artificial Sequence: Synthetic oligonucleotide
ggacatggcaagagatttaa

SEQ ID NO: 7433 - DNA, 20 bp, Artificial Sequence
  Description of Artificial Sequence: Synthetic oligonucleotide
gacatggcaagagatttaaa

SEQ ID NO: 7434 - DNA, 20 bp, Artificial Sequence
  Description of Artificial Sequence: Synthetic oligonucleotide
acatggcaagagatttaaac

SEQ ID NO: 7435 - DNA, 20 bp, Artificial Sequence
  Description of Artificial Sequence: Synthetic oligonucleotide
catggcaagagatttaaact

SEQ ID NO: 7436 - DNA, 20 bp, Artificial Sequence
  Description of Artificial Sequence: Synthetic oligonucleotide
atggcaagagatttaaacta

SEQ ID NO: 7437 - DNA, 20 bp, Artificial Sequence
  Description of Artificial Sequence: Synthetic oligonucleotide
tggcaagagatttaaactaa

SEQ ID NO: 7438 - DNA, 20 bp, Artificial Sequence
  Description of Artificial Sequence: Synthetic oligonucleotide
ggcaagagatttaaactaag

SEQ ID NO: 7439 - DNA, 20 bp, Artificial Sequence
  Description of Artificial Sequence: Synthetic oligonucleotide
gcaagagatttaaactaagt

SEQ ID NO: 7440 - DNA, 20 bp, Artificial Sequence
  Description of Artificial Sequence: Synthetic oligonucleotide
caagagatttaaactaagtt

SEQ ID NO: 7441 - DNA, 20 bp, Artificial Sequence
  Description of Artificial Sequence: Synthetic oligonucleotide
aagagatttaaactaagtta

SEQ ID NO: 7442 - DNA, 20 bp, Artificial Sequence
  Description of Artificial Sequence: Synthetic oligonucleotide
agagatttaaactaagttat

SEQ ID NO: 7443 - DNA, 20 bp, Artificial Sequence
  Description of Artificial Sequence: Synthetic oligonucleotide
gagatttaaactaagttatg

SEQ ID NO: 7444 - DNA, 20 bp, Artificial Sequence
  Description of Artificial Sequence: Synthetic oligonucleotide
agatttaaactaagttatgt

SEQ ID NO: 7445 - DNA, 20 bp, Artificial Sequence
  Description of Artificial Sequence: Synthetic oligonucleotide
gatttaaactaagttatgtg

SEQ ID NO: 7446 - DNA, 20 bp, Artificial Sequence
  Description of Artificial Sequence: Synthetic oligonucleotide
atttaaactaagttatgtgg

SEQ ID NO: 7447 - DNA, 20 bp, Artificial Sequence
  Description of Artificial Sequence: Synthetic oligonucleotide
tttaaactaagttatgtggt

SEQ ID NO: 7448 - DNA, 20 bp, Artificial Sequence
  Description of Artificial Sequence: Synthetic oligonucleotide
ttaaactaagttatgtggtg

SEQ ID NO: 7449 - DNA, 20 bp, Artificial Sequence
  Description of Artificial Sequence: Synthetic oligonucleotide
taaactaagttatgtggtgg

SEQ ID NO: 7450 - DNA, 20 bp, Artificial Sequence
  Description of Artificial Sequence: Synthetic oligonucleotide
aaactaagttatgtggtggt

SEQ ID NO: 7451 - DNA, 20 bp, Artificial Sequence
  Description of Artificial Sequence: Synthetic oligonucleotide
aactaagttatgtggtggtt

SEQ ID NO: 7452 - DNA, 20 bp, Artificial Sequence
  Description of Artificial Sequence: Synthetic oligonucleotide
actaagttatgtggtggtta

SEQ ID NO: 7453 - DNA, 20 bp, Artificial Sequence
  Description of Artificial Sequence: Synthetic oligonucleotide
ctaagttatgtggtggttat

SEQ ID NO: 7454 - DNA, 20 bp, Artificial Sequence
  Description of Artificial Sequence: Synthetic oligonucleotide
taagttatgtggtggttata

SEQ ID NO: 7455 - DNA, 20 bp, Artificial Sequence
  Description of Artificial Sequence: Synthetic oligonucleotide
aagttatgtggtggttataa

SEQ ID NO: 7456 - DNA, 20 bp, Artificial Sequence
  Description of Artificial Sequence: Synthetic oligonucleotide
agttatgtggtggttataag

SEQ ID NO: 7457 - DNA, 20 bp, Artificial Sequence
  Description of Artificial Sequence: Synthetic oligonucleotide
gttatgtggtggttataaga

SEQ ID NO: 7458 - DNA, 20 bp, Artificial Sequence
  Description of Artificial Sequence: Synthetic oligonucleotide
ttatgtggtggttataagaa

SEQ ID NO: 7459 - DNA, 20 bp, Artificial Sequence
  Description of Artificial Sequence: Synthetic oligonucleotide
tatgtggtggttataagaat

SEQ ID NO: 7460 - DNA, 20 bp, Artificial Sequence
  Description of Artificial Sequence: Synthetic oligonucleotide
atgtggtggttataagaatg

SEQ ID NO: 7461 - DNA, 20 bp, Artificial Sequence
  Description of Artificial Sequence: Synthetic oligonucleotide
tgtggtggttataagaatga

SEQ ID NO: 7462 - DNA, 20 bp, Artificial Sequence
  Description of Artificial Sequence: Synthetic oligonucleotide
gtggtggttataagaatgat

SEQ ID NO: 7463 - DNA, 20 bp, Artificial Sequence
  Description of Artificial Sequence: Synthetic oligonucleotide
tggtggttataagaatgatc

SEQ ID NO: 7464 - DNA, 20 bp, Artificial Sequence
  Description of Artificial Sequence: Synthetic oligonucleotide
ggtggttataagaatgatct

SEQ ID NO: 7465 - DNA, 20 bp, Artificial Sequence
  Description of Artificial Sequence: Synthetic oligonucleotide
gtggttataagaatgatctg

SEQ ID NO: 7466 - DNA, 20 bp, Artificial Sequence
  Description of Artificial Sequence: Synthetic oligonucleotide
tggttataagaatgatctga

SEQ ID NO: 7467 - DNA, 20 bp, Artificial Sequence
  Description of Artificial Sequence: Synthetic oligonucleotide
ggttataagaatgatctgat

SEQ ID NO: 7468 - DNA, 20 bp, Artificial Sequence
  Description of Artificial Sequence: Synthetic oligonucleotide
gttataagaatgatctgatc

SEQ ID NO: 7469 - DNA, 20 bp, Artificial Sequence
  Description of Artificial Sequence: Synthetic oligonucleotide
ttataagaatgatctgatct

SEQ ID NO: 7470 - DNA, 20 bp, Artificial Sequence
  Description of Artificial Sequence: Synthetic oligonucleotide
tataagaatgatctgatcta

SEQ ID NO: 7471 - DNA, 20 bp, Artificial Sequence
  Description of Artificial Sequence: Synthetic oligonucleotide
ataagaatgatctgatctat

SEQ ID NO: 7472 - DNA, 20 bp, Artificial Sequence
  Description of Artificial Sequence: Synthetic oligonucleotide
taagaatgatctgatctatg

SEQ ID NO: 7473 - DNA, 20 bp, Artificial Sequence
  Description of Artificial Sequence: Synthetic oligonucleotide
aagaatgatctgatctatgt

SEQ ID NO: 7474 - DNA, 20 bp, Artificial Sequence
  Description of Artificial Sequence: Synthetic oligonucleotide
agaatgatctgatctatgtt

SEQ ID NO: 7475 - DNA, 20 bp, Artificial Sequence
  Description of Artificial Sequence: Synthetic oligonucleotide
gaatgatctgatctatgtta

SEQ ID NO: 7476 - DNA, 20 bp, Artificial Sequence
  Description of Artificial Sequence: Synthetic oligonucleotide
aatgatctgatctatgttag

SEQ ID NO: 7477 - DNA, 20 bp, Artificial Sequence
  Description of Artificial Sequence: Synthetic oligonucleotide
atgatctgatctatgttaga

SEQ ID NO: 7478 - DNA, 20 bp, Artificial Sequence
  Description of Artificial Sequence: Synthetic oligonucleotide
tgatctgatctatgttagaa

SEQ ID NO: 7479 - DNA, 20 bp, Artificial Sequence
  Description of Artificial Sequence: Synthetic oligonucleotide
gatctgatctatgttagaag

SEQ ID NO: 7480 - DNA, 20 bp, Artificial Sequence
  Description of Artificial Sequence: Synthetic oligonucleotide
atctgatctatgttagaagg

SEQ ID NO: 7481 - DNA, 20 bp, Artificial Sequence
  Description of Artificial Sequence: Synthetic oligonucleotide
tctgatctatgttagaaggc

SEQ ID NO: 7482 - DNA, 20 bp, Artificial Sequence
  Description of Artificial Sequence: Synthetic oligonucleotide
ctgatctatgttagaaggct

SEQ ID NO: 7483 - DNA, 20 bp, Artificial Sequence
  Description of Artificial Sequence: Synthetic oligonucleotide
tgatctatgttagaaggctt

SEQ ID NO: 7484 - DNA, 20 bp, Artificial Sequence
  Description of Artificial Sequence: Synthetic oligonucleotide
gatctatgttagaaggcttg

SEQ ID NO: 7485 - DNA, 20 bp, Artificial Sequence
  Description of Artificial Sequence: Synthetic oligonucleotide
atctatgttagaaggcttgt

SEQ ID NO: 7486 - DNA, 20 bp, Artificial Sequence
  Description of Artificial Sequence: Synthetic oligonucleotide
tctatgttagaaggcttgtt

SEQ ID NO: 7487 - DNA, 20 bp, Artificial Sequence
  Description of Artificial Sequence: Synthetic oligonucleotide
ctatgttagaaggcttgttg

SEQ ID NO: 7488 - DNA, 20 bp, Artificial Sequence
  Description of Artificial Sequence: Synthetic oligonucleotide
tatgttagaaggcttgttgt

SEQ ID NO: 7489 - DNA, 20 bp, Artificial Sequence
  Description of Artificial Sequence: Synthetic oligonucleotide
atgttagaaggcttgttgtt

SEQ ID NO: 7490 - DNA, 20 bp, Artificial Sequence
  Description of Artificial Sequence: Synthetic oligonucleotide
tgttagaaggcttgttgttt

SEQ ID NO: 7491 - DNA, 20 bp, Artificial Sequence
  Description of Artificial Sequence: Synthetic oligonucleotide
gttagaaggcttgttgtttg

SEQ ID NO: 7492 - DNA, 20 bp, Artificial Sequence
  Description of Artificial Sequence: Synthetic oligonucleotide
ttagaaggcttgttgtttga

SEQ ID NO: 7493 - DNA, 20 bp, Artificial Sequence
  Description of Artificial Sequence: Synthetic oligonucleotide
tagaaggcttgttgtttgac

SEQ ID NO: 7494 - DNA, 20 bp, Artificial Sequence
  Description of Artificial Sequence: Synthetic oligonucleotide
agaaggcttgttgtttgact

SEQ ID NO: 7495 - DNA, 20 bp, Artificial Sequence
  Description of Artificial Sequence: Synthetic oligonucleotide
gaaggcttgttgtttgactg

SEQ ID NO: 7496 - DNA, 20 bp, Artificial Sequence
  Description of Artificial Sequence: Synthetic oligonucleotide
aaggcttgttgtttgactga

SEQ ID NO: 7497 - DNA, 20 bp, Artificial Sequence
  Description of Artificial Sequence: Synthetic oligonucleotide
aggcttgttgtttgactgat

SEQ ID NO: 7498 - DNA, 20 bp, Artificial Sequence
  Description of Artificial Sequence: Synthetic oligonucleotide
ggcttgttgtttgactgata

SEQ ID NO: 7499 - DNA, 20 bp, Artificial Sequence
  Description of Artificial Sequence: Synthetic oligonucleotide
gcttgttgtttgactgataa

SEQ ID NO: 7500 - DNA, 20 bp, Artificial Sequence
  Description of Artificial Sequence: Synthetic oligonucleotide
cttgttgtttgactgataat

SEQ ID NO: 7501 - DNA, 20 bp, Artificial Sequence
  Description of Artificial Sequence: Synthetic oligonucleotide
ttgttgtttgactgataatg

SEQ ID NO: 7502 - DNA, 20 bp, Artificial Sequence
  Description of Artificial Sequence: Synthetic oligonucleotide
tgttgtttgactgataatga

SEQ ID NO: 7503 - DNA, 20 bp, Artificial Sequence
  Description of Artificial Sequence: Synthetic oligonucleotide
gttgtttgactgataatgat

SEQ ID NO: 7504 - DNA, 20 bp, Artificial Sequence
  Description of Artificial Sequence: Synthetic oligonucleotide
ttgtttgactgataatgatt

SEQ ID NO: 7505 - DNA, 20 bp, Artificial Sequence
  Description of Artificial Sequence: Synthetic oligonucleotide
tgtttgactgataatgattt

SEQ ID NO: 7506 - DNA, 20 bp, Artificial Sequence
  Description of Artificial Sequence: Synthetic oligonucleotide
gtttgactgataatgatttg

SEQ ID NO: 7507 - DNA, 20 bp, Artificial Sequence
  Description of Artificial Sequence: Synthetic oligonucleotide
tttgactgataatgatttga

SEQ ID NO: 7508 - DNA, 20 bp, Artificial Sequence
  Description of Artificial Sequence: Synthetic oligonucleotide
ttgactgataatgatttgaa

SEQ ID NO: 7509 - DNA, 20 bp, Artificial Sequence
  Description of Artificial Sequence: Synthetic oligonucleotide
tgactgataatgatttgaag

SEQ ID NO: 7510 - DNA, 20 bp, Artificial Sequence
  Description of Artificial Sequence: Synthetic oligonucleotide
gactgataatgatttgaagg

SEQ ID NO: 7511 - DNA, 20 bp, Artificial Sequence
  Description of Artificial Sequence: Synthetic oligonucleotide
actgataatgatttgaaggg

SEQ ID NO: 7512 - DNA, 20 bp, Artificial Sequence
  Description of Artificial Sequence: Synthetic oligonucleotide
ctgataatgatttgaagggg

SEQ ID NO: 7513 - DNA, 20 bp, Artificial Sequence
  Description of Artificial Sequence: Synthetic oligonucleotide
tgataatgatttgaaggggc

SEQ ID NO: 7514 - DNA, 20 bp, Artificial Sequence
  Description of Artificial Sequence: Synthetic oligonucleotide
gataatgatttgaaggggcc

SEQ ID NO: 7515 - DNA, 20 bp, Artificial Sequence
  Description of Artificial Sequence: Synthetic oligonucleotide
ataatgatttgaaggggcca

SEQ ID NO: 7516 - DNA, 20 bp, Artificial Sequence
  Description of Artificial Sequence: Synthetic oligonucleotide
taatgatttgaaggggccaa

SEQ ID NO: 7517 - DNA, 20 bp, Artificial Sequence
  Description of Artificial Sequence: Synthetic oligonucleotide
aatgatttgaaggggccaaa

SEQ ID NO: 7518 - DNA, 20 bp, Artificial Sequence
  Description of Artificial Sequence: Synthetic oligonucleotide
atgatttgaaggggccaaac

SEQ ID NO: 7519 - DNA, 20 bp, Artificial Sequence
  Description of Artificial Sequence: Synthetic oligonucleotide
tgatttgaaggggccaaaca

SEQ ID NO: 7520 - DNA, 20 bp, Artificial Sequence
  Description of Artificial Sequence: Synthetic oligonucleotide
gatttgaaggggccaaacag

SEQ ID NO: 7521 - DNA, 20 bp, Artificial Sequence
  Description of Artificial Sequence: Synthetic oligonucleotide
atttgaaggggccaaacaga

SEQ ID NO: 7522 - DNA, 20 bp, Artificial Sequence
  Description of Artificial Sequence: Synthetic oligonucleotide
tttgaaggggccaaacagat

SEQ ID NO: 7523 - DNA, 20 bp, Artificial Sequence
  Description of Artificial Sequence: Synthetic oligonucleotide
ttgaaggggccaaacagatg

SEQ ID NO: 7524 - DNA, 20 bp, Artificial Sequence
  Description of Artificial Sequence: Synthetic oligonucleotide
tgaaggggccaaacagatgc

SEQ ID NO: 7525 - DNA, 20 bp, Artificial Sequence
  Description of Artificial Sequence: Synthetic oligonucleotide
gaaggggccaaacagatgcc

SEQ ID NO: 7526 - DNA, 20 bp, Artificial Sequence
  Description of Artificial Sequence: Synthetic oligonucleotide
aaggggccaaacagatgcct

SEQ ID NO: 7527 - DNA, 20 bp, Artificial Sequence
  Description of Artificial Sequence: Synthetic oligonucleotide
aggggccaaacagatgcctg

SEQ ID NO: 7528 - DNA, 20 bp, Artificial Sequence
  Description of Artificial Sequence: Synthetic oligonucleotide
ggggccaaacagatgcctgg

SEQ ID NO: 7529 - DNA, 20 bp, Artificial Sequence
  Description of Artificial Sequence: Synthetic oligonucleotide
gggccaaacagatgcctggg

SEQ ID NO: 7530 - DNA, 20 bp, Artificial Sequence
  Description of Artificial Sequence: Synthetic oligonucleotide
ggccaaacagatgcctgggt

SEQ ID NO: 7531 - DNA, 20 bp, Artificial Sequence
  Description of Artificial Sequence: Synthetic oligonucleotide
gccaaacagatgcctgggtt

SEQ ID NO: 7532 - DNA, 20 bp, Artificial Sequence
  Description of Artificial Sequence: Synthetic oligonucleotide
ccaaacagatgcctgggttt

SEQ ID NO: 7533 - DNA, 20 bp, Artificial Sequence
  Description of Artificial Sequence: Synthetic oligonucleotide
caaacagatgcctgggtttg

SEQ ID NO: 7534 - DNA, 20 bp, Artificial Sequence
  Description of Artificial Sequence: Synthetic oligonucleotide
aaacagatgcctgggtttgg

SEQ ID NO: 7535 - DNA, 20 bp, Artificial Sequence
  Description of Artificial Sequence: Synthetic oligonucleotide
aacagatgcctgggtttgga

SEQ ID NO: 7536 - DNA, 20 bp, Artificial Sequence
  Description of Artificial Sequence: Synthetic oligonucleotide
acagatgcctgggtttggag

SEQ ID NO: 7537 - DNA, 20 bp, Artificial Sequence
  Description of Artificial Sequence: Synthetic oligonucleotide
cagatgcctgggtttggagt

SEQ ID NO: 7538 - DNA, 20 bp, Artificial Sequence
  Description of Artificial Sequence: Synthetic oligonucleotide
agatgcctgggtttggagtg

SEQ ID NO: 7539 - DNA, 20 bp, Artificial Sequence
  Description of Artificial Sequence: Synthetic oligonucleotide
gatgcctgggtttggagtgc

SEQ ID NO: 7540 - DNA, 20 bp, Artificial Sequence
  Description of Artificial Sequence: Synthetic oligonucleotide
atgcctgggtttggagtgca

SEQ ID NO: 7541 - DNA, 20 bp, Artificial Sequence
  Description of Artificial Sequence: Synthetic oligonucleotide
tgcctgggtttggagtgcag

SEQ ID NO: 7542 - DNA, 20 bp, Artificial Sequence
  Description of Artificial Sequence: Synthetic oligonucleotide
gcctgggtttggagtgcagg

SEQ ID NO: 7543 - DNA, 20 bp, Artificial Sequence
  Description of Artificial Sequence: Synthetic oligonucleotide
cctgggtttggagtgcaggg

SEQ ID NO: 7544 - DNA, 20 bp, Artificial Sequence
  Description of Artificial Sequence: Synthetic oligonucleotide
ctgggtttggagtgcagggc

SEQ ID NO: 7545 - DNA, 20 bp, Artificial Sequence
  Description of Artificial Sequence: Synthetic oligonucleotide
tgggtttggagtgcagggca

SEQ ID NO: 7546 - DNA, 20 bp, Artificial Sequence
  Description of Artificial Sequence: Synthetic oligonucleotide
gggtttggagtgcagggcat

SEQ ID NO: 7547 - DNA, 20 bp, Artificial Sequence
  Description of Artificial Sequence: Synthetic oligonucleotide
ggtttggagtgcagggcata

SEQ ID NO: 7548 - DNA, 20 bp, Artificial Sequence
  Description of Artificial Sequence: Synthetic oligonucleotide
gtttggagtgcagggcataa

SEQ ID NO: 7549 - DNA, 20 bp, Artificial Sequence
  Description of Artificial Sequence: Synthetic oligonucleotide
tttggagtgcagggcataaa

SEQ ID NO: 7550 - DNA, 20 bp, Artificial Sequence
  Description of Artificial Sequence: Synthetic oligonucleotide
ttggagtgcagggcataaac

SEQ ID NO: 7551 - DNA, 20 bp, Artificial Sequence
  Description of Artificial Sequence: Synthetic oligonucleotide
tggagtgcagggcataaact

SEQ ID NO: 7552 - DNA, 20 bp, Artificial Sequence
  Description of Artificial Sequence: Synthetic oligonucleotide
ggagtgcagggcataaactg

SEQ ID NO: 7553 - DNA, 20 bp, Artificial Sequence
  Description of Artificial Sequence: Synthetic oligonucleotide
gagtgcagggcataaactga

SEQ ID NO: 7554 - DNA, 20 bp, Artificial Sequence
  Description of Artificial Sequence: Synthetic oligonucleotide
agtgcagggcataaactgag

SEQ ID NO: 7555 - DNA, 20 bp, Artificial Sequence
  Description of Artificial Sequence: Synthetic oligonucleotide
gtgcagggcataaactgagt

SEQ ID NO: 7556 - DNA, 20 bp, Artificial Sequence
  Description of Artificial Sequence: Synthetic oligonucleotide
tgcagggcataaactgagtg

SEQ ID NO: 7557 - DNA, 20 bp, Artificial Sequence
  Description of Artificial Sequence: Synthetic oligonucleotide
gcagggcataaactgagtgt

SEQ ID NO: 7558 - DNA, 20 bp, Artificial Sequence
  Description of Artificial Sequence: Synthetic oligonucleotide
cagggcataaactgagtgtt

SEQ ID NO: 7559 - DNA, 20 bp, Artificial Sequence
  Description of Artificial Sequence: Synthetic oligonucleotide
agggcataaactgagtgttt

SEQ ID NO: 7560 - DNA, 20 bp, Artificial Sequence
  Description of Artificial Sequence: Synthetic oligonucleotide
gggcataaactgagtgtttg

SEQ ID NO: 7561 - DNA, 20 bp, Artificial Sequence
  Description of Artificial Sequence: Synthetic oligonucleotide
ggcataaactgagtgtttgc

SEQ ID NO: 7562 - DNA, 20 bp, Artificial Sequence
  Description of Artificial Sequence: Synthetic oligonucleotide
gcataaactgagtgtttgca

SEQ ID NO: 7563 - DNA, 20 bp, Artificial Sequence
  Description of Artificial Sequence: Synthetic oligonucleotide
cataaactgagtgtttgcat

SEQ ID NO: 7564 - DNA, 20 bp, Artificial Sequence
  Description of Artificial Sequence: Synthetic oligonucleotide
ataaactgagtgtttgcata

SEQ ID NO: 7565 - DNA, 20 bp, Artificial Sequence
  Description of Artificial Sequence: Synthetic oligonucleotide
taaactgagtgtttgcatag

SEQ ID NO: 7566 - DNA, 20 bp, Artificial Sequence
  Description of Artificial Sequence: Synthetic oligonucleotide
aaactgagtgtttgcatagc

SEQ ID NO: 7567 - DNA, 20 bp, Artificial Sequence
  Description of Artificial Sequence: Synthetic oligonucleotide
aactgagtgtttgcatagct

SEQ ID NO: 7568 - DNA, 20 bp, Artificial Sequence
  Description of Artificial Sequence: Synthetic oligonucleotide
actgagtgtttgcatagctc

SEQ ID NO: 7569 - DNA, 20 bp, Artificial Sequence
  Description of Artificial Sequence: Synthetic oligonucleotide
ctgagtgtttgcatagctct

SEQ ID NO: 7570 - DNA, 20 bp, Artificial Sequence
  Description of Artificial Sequence: Synthetic oligonucleotide
tgagtgtttgcatagctctg

SEQ ID NO: 7571 - DNA, 20 bp, Artificial Sequence
  Description of Artificial Sequence: Synthetic oligonucleotide
gagtgtttgcatagctctgt

SEQ ID NO: 7572 - DNA, 20 bp, Artificial Sequence
  Description of Artificial Sequence: Synthetic oligonucleotide
agtgtttgcatagctctgtg

SEQ ID NO: 7573 - DNA, 20 bp, Artificial Sequence
  Description of Artificial Sequence: Synthetic oligonucleotide
gtgtttgcatagctctgtgg

SEQ ID NO: 7574 - DNA, 20 bp, Artificial Sequence
  Description of Artificial Sequence: Synthetic oligonucleotide
tgtttgcatagctctgtggt

SEQ ID NO: 7575 - DNA, 20 bp, Artificial Sequence
  Description of Artificial Sequence: Synthetic oligonucleotide
gtttgcatagctctgtggtg

SEQ ID NO: 7576 - DNA, 20 bp, Artificial Sequence
  Description of Artificial Sequence: Synthetic oligonucleotide
tttgcatagctctgtggtgt

SEQ ID NO: 7577 - DNA, 20 bp, Artificial Sequence
  Description of Artificial Sequence: Synthetic oligonucleotide
ttgcatagctctgtggtgtt

SEQ ID NO: 7578 - DNA, 20 bp, Artificial Sequence
  Description of Artificial Sequence: Synthetic oligonucleotide
tgcatagctctgtggtgttt

SEQ ID NO: 7579 - DNA, 20 bp, Artificial Sequence
  Description of Artificial Sequence: Synthetic oligonucleotide
gcatagctctgtggtgtttg

SEQ ID NO: 7580 - DNA, 20 bp, Artificial Sequence
  Description of Artificial Sequence: Synthetic oligonucleotide
catagctctgtggtgtttgg

SEQ ID NO: 7581 - DNA, 20 bp, Artificial Sequence
  Description of Artificial Sequence: Synthetic oligonucleotide
atagctctgtggtgtttggt

SEQ ID NO: 7582 - DNA, 20 bp, Artificial Sequence
  Description of Artificial Sequence: Synthetic oligonucleotide
tagctctgtggtgtttggtg

SEQ ID NO: 7583 - DNA, 20 bp, Artificial Sequence
  Description of Artificial Sequence: Synthetic oligonucleotide
agctctgtggtgtttggtgt

SEQ ID NO: 7584 - DNA, 20 bp, Artificial Sequence
  Description of Artificial Sequence: Synthetic oligonucleotide
gctctgtggtgtttggtgtg

SEQ ID NO: 7585 - DNA, 20 bp, Artificial Sequence
  Description of Artificial Sequence: Synthetic oligonucleotide
ctctgtggtgtttggtgtgt

SEQ ID NO: 7586 - DNA, 20 bp, Artificial Sequence
  Description of Artificial Sequence: Synthetic oligonucleotide
tctgtggtgtttggtgtgtt

SEQ ID NO: 7587 - DNA, 20 bp, Artificial Sequence
  Description of Artificial Sequence: Synthetic oligonucleotide
ctgtggtgtttggtgtgttt

SEQ ID NO: 7588 - DNA, 20 bp, Artificial Sequence
  Description of Artificial Sequence: Synthetic oligonucleotide
tgtggtgtttggtgtgtttg

SEQ ID NO: 7589 - DNA, 20 bp, Artificial Sequence
  Description of Artificial Sequence: Synthetic oligonucleotide
gtggtgtttggtgtgtttgc

SEQ ID NO: 7590 - DNA, 20 bp, Artificial Sequence
  Description of Artificial Sequence: Synthetic oligonucleotide
tggtgtttggtgtgtttgct

SEQ ID NO: 7591 - DNA, 20 bp, Artificial Sequence
  Description of Artificial Sequence: Synthetic oligonucleotide
ggtgtttggtgtgtttgctt

SEQ ID NO: 7592 - DNA, 20 bp, Artificial Sequence
  Description of Artificial Sequence: Synthetic oligonucleotide
gtgtttggtgtgtttgcttg

SEQ ID NO: 7593 - DNA, 20 bp, Artificial Sequence
  Description of Artificial Sequence: Synthetic oligonucleotide
tgtttggtgtgtttgcttgt

SEQ ID NO: 7594 - DNA, 20 bp, Artificial Sequence
  Description of Artificial Sequence: Synthetic oligonucleotide
gtttggtgtgtttgcttgtg

SEQ ID NO: 7595 - DNA, 20 bp, Artificial Sequence
  Description of Artificial Sequence: Synthetic oligonucleotide
tttggtgtgtttgcttgtgt

SEQ ID NO: 7596 - DNA, 20 bp, Artificial Sequence
  Description of Artificial Sequence: Synthetic oligonucleotide
ttggtgtgtttgcttgtgtt

SEQ ID NO: 7597 - DNA, 20 bp, Artificial Sequence
  Description of Artificial Sequence: Synthetic oligonucleotide
tggtgtgtttgcttgtgttt

SEQ ID NO: 7598 - DNA, 20 bp, Artificial Sequence
  Description of Artificial Sequence: Synthetic oligonucleotide
ggtgtgtttgcttgtgtttg

SEQ ID NO: 7599 - DNA, 20 bp, Artificial Sequence
  Description of Artificial Sequence: Synthetic oligonucleotide
gtgtgtttgcttgtgtttga

SEQ ID NO: 7600 - DNA, 20 bp, Artificial Sequence
  Description of Artificial Sequence: Synthetic oligonucleotide
tgtgtttgcttgtgtttgag

SEQ ID NO: 7601 - DNA, 20 bp, Artificial Sequence
  Description of Artificial Sequence: Synthetic oligonucleotide
gtgtttgcttgtgtttgagt

SEQ ID NO: 7602 - DNA, 20 bp, Artificial Sequence
  Description of Artificial Sequence: Synthetic oligonucleotide
tgtttgcttgtgtttgagtt

SEQ ID NO: 7603 - DNA, 20 bp, Artificial Sequence
  Description of Artificial Sequence: Synthetic oligonucleotide
gtttgcttgtgtttgagttt

SEQ ID NO: 7604 - DNA, 20 bp, Artificial Sequence
  Description of Artificial Sequence: Synthetic oligonucleotide
tttgcttgtgtttgagtttt

SEQ ID NO: 7605 - DNA, 20 bp, Artificial Sequence
  Description of Artificial Sequence: Synthetic oligonucleotide
ttgcttgtgtttgagttttc

SEQ ID NO: 7606 - DNA, 20 bp, Artificial Sequence
  Description of Artificial Sequence: Synthetic oligonucleotide
tgcttgtgtttgagttttcc

SEQ ID NO: 7607 - DNA, 20 bp, Artificial Sequence
  Description of Artificial Sequence: Synthetic oligonucleotide
gcttgtgtttgagttttcct

SEQ ID NO: 7608 - DNA, 20 bp, Artificial Sequence
  Description of Artificial Sequence: Synthetic oligonucleotide
cttgtgtttgagttttcctt

SEQ ID NO: 7609 - DNA, 20 bp, Artificial Sequence
  Description of Artificial Sequence: Synthetic oligonucleotide
ttgtgtttgagttttccttt

SEQ ID NO: 7610 - DNA, 20 bp, Artificial Sequence
  Description of Artificial Sequence: Synthetic oligonucleotide
tgtgtttgagttttcctttt

SEQ ID NO: 7611 - DNA, 20 bp, Artificial Sequence
  Description of Artificial Sequence: Synthetic oligonucleotide
gtgtttgagttttccttttt

SEQ ID NO: 7612 - DNA, 20 bp, Artificial Sequence
  Description of Artificial Sequence: Synthetic oligonucleotide
tgtttgagttttcctttttt

SEQ ID NO: 7613 - DNA, 20 bp, Artificial Sequence
  Description of Artificial Sequence: Synthetic oligonucleotide
gtttgagttttccttttttt

SEQ ID NO: 7614 - DNA, 20 bp, Artificial Sequence
  Description of Artificial Sequence: Synthetic oligonucleotide
tttgagttttcctttttttt

SEQ ID NO: 7615 - DNA, 20 bp, Artificial Sequence
  Description of Artificial Sequence: Synthetic oligonucleotide
ttgagttttccttttttttt

SEQ ID NO: 7616 - DNA, 20 bp, Artificial Sequence
  Description of Artificial Sequence: Synthetic oligonucleotide
tgagttttcctttttttttt

SEQ ID NO: 7617 - DNA, 20 bp, Artificial Sequence
  Description of Artificial Sequence: Synthetic oligonucleotide
gagttttccttttttttttt

SEQ ID NO: 7618 - DNA, 20 bp, Artificial Sequence
  Description of Artificial Sequence: Synthetic oligonucleotide
agttttcctttttttttttt

SEQ ID NO: 7619 - DNA, 20 bp, Artificial Sequence
  Description of Artificial Sequence: Synthetic oligonucleotide
gttttccttttttttttttt

SEQ ID NO: 7620 - DNA, 20 bp, Artificial Sequence
  Description of Artificial Sequence: Synthetic oligonucleotide
ttttcctttttttttttttt

SEQ ID NO: 7621 - DNA, 20 bp, Artificial Sequence
  Description of Artificial Sequence: Synthetic oligonucleotide
tttccttttttttttttttt

SEQ ID NO: 7622 - DNA, 20 bp, Artificial Sequence
  Description of Artificial Sequence: Synthetic oligonucleotide
ttcctttttttttttttttt

SEQ ID NO: 7623 - DNA, 20 bp, Artificial Sequence
  Description of Artificial Sequence: Synthetic oligonucleotide
tccttttttttttttttttt

SEQ ID NO: 7624 - DNA, 20 bp, Artificial Sequence
  Description of Artificial Sequence: Synthetic oligonucleotide
cctttttttttttttttttt

SEQ ID NO: 7625 - DNA, 20 bp, Artificial Sequence
  Description of Artificial Sequence: Synthetic oligonucleotide
cttttttttttttttttttt

SEQ ID NO: 7626 - DNA, 20 bp, Artificial Sequence
  Description of Artificial Sequence: Synthetic oligonucleotide
tttttttttttttttttttt

SEQ ID NO: 7627 - DNA, 20 bp, Artificial Sequence
  Description of Artificial Sequence: Synthetic oligonucleotide
ttttttttttttttttttta

SEQ ID NO: 7628 - DNA, 20 bp, Artificial Sequence
  Description of Artificial Sequence: Synthetic oligonucleotide
ttttttttttttttttttaa

SEQ ID NO: 7629 - DNA, 20 bp, Artificial Sequence
  Description of Artificial Sequence: Synthetic oligonucleotide
tttttttttttttttttaat

SEQ ID NO: 7630 - DNA, 20 bp, Artificial Sequence
  Description of Artificial Sequence: Synthetic oligonucleotide
ttttttttttttttttaatt

SEQ ID NO: 7631 - DNA, 20 bp, Artificial Sequence
  Description of Artificial Sequence: Synthetic oligonucleotide
tttttttttttttttaattg

SEQ ID NO: 7632 - DNA, 20 bp, Artificial Sequence
  Description of Artificial Sequence: Synthetic oligonucleotide
ttttttttttttttaattga

SEQ ID NO: 7633 - DNA, 20 bp, Artificial Sequence
  Description of Artificial Sequence: Synthetic oligonucleotide
tttttttttttttaattgaa

SEQ ID NO: 7634 - DNA, 20 bp, Artificial Sequence
  Description of Artificial Sequence: Synthetic oligonucleotide
ttttttttttttaattgaaa

SEQ ID NO: 7635 - DNA, 20 bp, Artificial Sequence
  Description of Artificial Sequence: Synthetic oligonucleotide
tttttttttttaattgaaat

SEQ ID NO: 7636 - DNA, 20 bp, Artificial Sequence
  Description of Artificial Sequence: Synthetic oligonucleotide
ttttttttttaattgaaatg

SEQ ID NO: 7637 - DNA, 20 bp, Artificial Sequence
  Description of Artificial Sequence: Synthetic oligonucleotide
tttttttttaattgaaatgg

SEQ ID NO: 7638 - DNA, 20 bp, Artificial Sequence
  Description of Artificial Sequence: Synthetic oligonucleotide
ttttttttaattgaaatgga

SEQ ID NO: 7639 - DNA, 20 bp, Artificial Sequence
  Description of Artificial Sequence: Synthetic oligonucleotide
tttttttaattgaaatggag

SEQ ID NO: 7640 - DNA, 20 bp, Artificial Sequence
  Description of Artificial Sequence: Synthetic oligonucleotide
ttttttaattgaaatggagt

SEQ ID NO: 7641 - DNA, 20 bp, Artificial Sequence
  Description of Artificial Sequence: Synthetic oligonucleotide
tttttaattgaaatggagtc

SEQ ID NO: 7642 - DNA, 20 bp, Artificial Sequence
  Description of Artificial Sequence: Synthetic oligonucleotide
ttttaattgaaatggagtct

SEQ ID NO: 7643 - DNA, 20 bp, Artificial Sequence
  Description of Artificial Sequence: Synthetic oligonucleotide
tttaattgaaatggagtctc

SEQ ID NO: 7644 - DNA, 20 bp, Artificial Sequence
  Description of Artificial Sequence: Synthetic oligonucleotide
ttaattgaaatggagtctca

SEQ ID NO: 7645 - DNA, 20 bp, Artificial Sequence
  Description of Artificial Sequence: Synthetic oligonucleotide
taattgaaatggagtctcac

SEQ ID NO: 7646 - DNA, 20 bp, Artificial Sequence
  Description of Artificial Sequence: Synthetic oligonucleotide
aattgaaatggagtctcact

SEQ ID NO: 7647 - DNA, 20 bp, Artificial Sequence
  Description of Artificial Sequence: Synthetic oligonucleotide
attgaaatggagtctcactt

SEQ ID NO: 7648 - DNA, 20 bp, Artificial Sequence
  Description of Artificial Sequence: Synthetic oligonucleotide
ttgaaatggagtctcacttt

SEQ ID NO: 7649 - DNA, 20 bp, Artificial Sequence
  Description of Artificial Sequence: Synthetic oligonucleotide
tgaaatggagtctcactttg

SEQ ID NO: 7650 - DNA, 20 bp, Artificial Sequence
  Description of Artificial Sequence: Synthetic oligonucleotide
gaaatggagtctcactttgt

SEQ ID NO: 7651 - DNA, 20 bp, Artificial Sequence
  Description of Artificial Sequence: Synthetic oligonucleotide
aaatggagtctcactttgtc

SEQ ID NO: 7652 - DNA, 20 bp, Artificial Sequence
  Description of Artificial Sequence: Synthetic oligonucleotide
aatggagtctcactttgtct

SEQ ID NO: 7653 - DNA, 20 bp, Artificial Sequence
  Description of Artificial Sequence: Synthetic oligonucleotide
atggagtctcactttgtctc

SEQ ID NO: 7654 - DNA, 20 bp, Artificial Sequence
  Description of Artificial Sequence: Synthetic oligonucleotide
tggagtctcactttgtctcc

SEQ ID NO: 7655 - DNA, 20 bp, Artificial Sequence
  Description of Artificial Sequence: Synthetic oligonucleotide
ggagtctcactttgtctccc

SEQ ID NO: 7656 - DNA, 20 bp, Artificial Sequence
  Description of Artificial Sequence: Synthetic oligonucleotide
gagtctcactttgtctccca

SEQ ID NO: 7657 - DNA, 20 bp, Artificial Sequence
  Description of Artificial Sequence: Synthetic oligonucleotide
agtctcactttgtctcccag

SEQ ID NO: 7658 - DNA, 20 bp, Artificial Sequence
  Description of Artificial Sequence: Synthetic oligonucleotide
gtctcactttgtctcccaga

SEQ ID NO: 7659 - DNA, 20 bp, Artificial Sequence
  Description of Artificial Sequence: Synthetic oligonucleotide
tctcactttgtctcccagat

SEQ ID NO: 7660 - DNA, 20 bp, Artificial Sequence
  Description of Artificial Sequence: Synthetic oligonucleotide
ctcactttgtctcccagatt

SEQ ID NO: 7661 - DNA, 20 bp, Artificial Sequence
  Description of Artificial Sequence: Synthetic oligonucleotide
tcactttgtctcccagatta

SEQ ID NO: 7662 - DNA, 20 bp, Artificial Sequence
  Description of Artificial Sequence: Synthetic oligonucleotide
cactttgtctcccagattat

SEQ ID NO: 7663 - DNA, 20 bp, Artificial Sequence
  Description of Artificial Sequence: Synthetic oligonucleotide
actttgtctcccagattata

SEQ ID NO: 7664 - DNA, 20 bp, Artificial Sequence
  Description of Artificial Sequence: Synthetic oligonucleotide
ctttgtctcccagattatag

SEQ ID NO: 7665 - DNA, 20 bp, Artificial Sequence
  Description of Artificial Sequence: Synthetic oligonucleotide
tttgtctcccagattatagt

SEQ ID NO: 7666 - DNA, 20 bp, Artificial Sequence
  Description of Artificial Sequence: Synthetic oligonucleotide
ttgtctcccagattatagtg

SEQ ID NO: 7667 - DNA, 20 bp, Artificial Sequence
  Description of Artificial Sequence: Synthetic oligonucleotide
tgtctcccagattatagtgc

SEQ ID NO: 7668 - DNA, 20 bp, Artificial Sequence
  Description of Artificial Sequence: Synthetic oligonucleotide
gtctcccagattatagtgca

SEQ ID NO: 7669 - DNA, 20 bp, Artificial Sequence
  Description of Artificial Sequence: Synthetic oligonucleotide
tctcccagattatagtgcag

SEQ ID NO: 7670 - DNA, 20 bp, Artificial Sequence
  Description of Artificial Sequence: Synthetic oligonucleotide
ctcccagattatagtgcagt

SEQ ID NO: 7671 - DNA, 20 bp, Artificial Sequence
  Description of Artificial Sequence: Synthetic oligonucleotide
tcccagattatagtgcagtg

SEQ ID NO: 7672 - DNA, 20 bp, Artificial Sequence
  Description of Artificial Sequence: Synthetic oligonucleotide
cccagattatagtgcagtgg

SEQ ID NO: 7673 - DNA, 20 bp, Artificial Sequence
  Description of Artificial Sequence: Synthetic oligonucleotide
ccagattatagtgcagtggc

SEQ ID NO: 7674 - DNA, 20 bp, Artificial Sequence
  Description of Artificial Sequence: Synthetic oligonucleotide
cagattatagtgcagtggcg

SEQ ID NO: 7675 - DNA, 20 bp, Artificial Sequence
  Description of Artificial Sequence: Synthetic oligonucleotide
agattatagtgcagtggcgt

SEQ ID NO: 7676 - DNA, 20 bp, Artificial Sequence
  Description of Artificial Sequence: Synthetic oligonucleotide
gattatagtgcagtggcgtg

SEQ ID NO: 7677 - DNA, 20 bp, Artificial Sequence
  Description of Artificial Sequence: Synthetic oligonucleotide
attatagtgcagtggcgtga

SEQ ID NO: 7678 - DNA, 20 bp, Artificial Sequence
  Description of Artificial Sequence: Synthetic oligonucleotide
ttatagtgcagtggcgtgat

SEQ ID NO: 7679 - DNA, 20 bp, Artificial Sequence
  Description of Artificial Sequence: Synthetic oligonucleotide
tatagtgcagtggcgtgatc

SEQ ID NO: 7680 - DNA, 20 bp, Artificial Sequence
  Description of Artificial Sequence: Synthetic oligonucleotide
atagtgcagtggcgtgatct

SEQ ID NO: 7681 - DNA, 20 bp, Artificial Sequence
  Description of Artificial Sequence: Synthetic oligonucleotide
tagtgcagtggcgtgatctc

SEQ ID NO: 7682 - DNA, 20 bp, Artificial Sequence
  Description of Artificial Sequence: Synthetic oligonucleotide
agtgcagtggcgtgatctcg

SEQ ID NO: 7683 - DNA, 20 bp, Artificial Sequence
  Description of Artificial Sequence: Synthetic oligonucleotide
gtgcagtggcgtgatctcgg

SEQ ID NO: 7684 - DNA, 20 bp, Artificial Sequence
  Description of Artificial Sequence: Synthetic oligonucleotide
tgcagtggcgtgatctcggc

SEQ ID NO: 7685 - DNA, 20 bp, Artificial Sequence
  Description of Artificial Sequence: Synthetic oligonucleotide
gcagtggcgtgatctcggct

SEQ ID NO: 7686 - DNA, 20 bp, Artificial Sequence
  Description of Artificial Sequence: Synthetic oligonucleotide
cagtggcgtgatctcggctc

SEQ ID NO: 7687 - DNA, 20 bp, Artificial Sequence
  Description of Artificial Sequence: Synthetic oligonucleotide
agtggcgtgatctcggctca

SEQ ID NO: 7688 - DNA, 20 bp, Artificial Sequence
  Description of Artificial Sequence: Synthetic oligonucleotide
gtggcgtgatctcggctcac

SEQ ID NO: 7689 - DNA, 20 bp, Artificial Sequence
  Description of Artificial Sequence: Synthetic oligonucleotide
tggcgtgatctcggctcact

SEQ ID NO: 7690 - DNA, 20 bp, Artificial Sequence
  Description of Artificial Sequence: Synthetic oligonucleotide
ggcgtgatctcggctcactg

SEQ ID NO: 7691 - DNA, 20 bp, Artificial Sequence
  Description of Artificial Sequence: Synthetic oligonucleotide
gcgtgatctcggctcactgc

SEQ ID NO: 7692 - DNA, 20 bp, Artificial Sequence
  Description of Artificial Sequence: Synthetic oligonucleotide
cgtgatctcggctcactgca

SEQ ID NO: 7693 - DNA, 20 bp, Artificial Sequence
  Description of Artificial Sequence: Synthetic oligonucleotide
gtgatctcggctcactgcaa

SEQ ID NO: 7694 - DNA, 20 bp, Artificial Sequence
  Description of Artificial Sequence: Synthetic oligonucleotide
tgatctcggctcactgcaac

SEQ ID NO: 7695 - DNA, 20 bp, Artificial Sequence
  Description of Artificial Sequence: Synthetic oligonucleotide
gatctcggctcactgcaacc

SEQ ID NO: 7696 - DNA, 20 bp, Artificial Sequence
  Description of Artificial Sequence: Synthetic oligonucleotide
atctcggctcactgcaacct

SEQ ID NO: 7697 - DNA, 20 bp, Artificial Sequence
  Description of Artificial Sequence: Synthetic oligonucleotide
tctcggctcactgcaacctc

SEQ ID NO: 7698 - DNA, 20 bp, Artificial Sequence
  Description of Artificial Sequence: Synthetic oligonucleotide
ctcggctcactgcaacctct

SEQ ID NO: 7699 - DNA, 20 bp, Artificial Sequence
  Description of Artificial Sequence: Synthetic oligonucleotide
tcggctcactgcaacctctg

SEQ ID NO: 7700 - DNA, 20 bp, Artificial Sequence
  Description of Artificial Sequence: Synthetic oligonucleotide
cggctcactgcaacctctgc

SEQ ID NO: 7701 - DNA, 20 bp, Artificial Sequence
  Description of Artificial Sequence: Synthetic oligonucleotide
ggctcactgcaacctctgcc

SEQ ID NO: 7702 - DNA, 20 bp, Artificial Sequence
  Description of Artificial Sequence: Synthetic oligonucleotide
gctcactgcaacctctgcct

SEQ ID NO: 7703 - DNA, 20 bp, Artificial Sequence
  Description of Artificial Sequence: Synthetic oligonucleotide
ctcactgcaacctctgcctc

SEQ ID NO: 7704 - DNA, 20 bp, Artificial Sequence
  Description of Artificial Sequence: Synthetic oligonucleotide
tcactgcaacctctgcctcc

SEQ ID NO: 7705 - DNA, 20 bp, Artificial Sequence
  Description of Artificial Sequence: Synthetic oligonucleotide
cactgcaacctctgcctcct

SEQ ID NO: 7706 - DNA, 20 bp, Artificial Sequence
  Description of Artificial Sequence: Synthetic oligonucleotide
actgcaacctctgcctcctg

SEQ ID NO: 7707 - DNA, 20 bp, Artificial Sequence
  Description of Artificial Sequence: Synthetic oligonucleotide
ctgcaacctctgcctcctga

SEQ ID NO: 7708 - DNA, 20 bp, Artificial Sequence
  Description of Artificial Sequence: Synthetic oligonucleotide
tgcaacctctgcctcctgag

SEQ ID NO: 7709 - DNA, 20 bp, Artificial Sequence
  Description of Artificial Sequence: Synthetic oligonucleotide
gcaacctctgcctcctgagt

SEQ ID NO: 7710 - DNA, 20 bp, Artificial Sequence
  Description of Artificial Sequence: Synthetic oligonucleotide
caacctctgcctcctgagtt

SEQ ID NO: 7711 - DNA, 20 bp, Artificial Sequence
  Description of Artificial Sequence: Synthetic oligonucleotide
aacctctgcctcctgagttc

SEQ ID NO: 7712 - DNA, 20 bp, Artificial Sequence
  Description of Artificial Sequence: Synthetic oligonucleotide
acctctgcctcctgagttca

SEQ ID NO: 7713 - DNA, 20 bp, Artificial Sequence
  Description of Artificial Sequence: Synthetic oligonucleotide
cctctgcctcctgagttcaa

SEQ ID NO: 7714 - DNA, 20 bp, Artificial Sequence
  Description of Artificial Sequence: Synthetic oligonucleotide
ctctgcctcctgagttcaag

SEQ ID NO: 7715 - DNA, 20 bp, Artificial Sequence
  Description of Artificial Sequence: Synthetic oligonucleotide
tctgcctcctgagttcaagc

SEQ ID NO: 7716 - DNA, 20 bp, Artificial Sequence
  Description of Artificial Sequence: Synthetic oligonucleotide
ctgcctcctgagttcaagca

SEQ ID NO: 7717 - DNA, 20 bp, Artificial Sequence
  Description of Artificial Sequence: Synthetic oligonucleotide
tgcctcctgagttcaagcaa

SEQ ID NO: 7718 - DNA, 20 bp, Artificial Sequence
  Description of Artificial Sequence: Synthetic oligonucleotide
gcctcctgagttcaagcaat

SEQ ID NO: 7719 - DNA, 20 bp, Artificial Sequence
  Description of Artificial Sequence: Synthetic oligonucleotide
cctcctgagttcaagcaatc

SEQ ID NO: 7720 - DNA, 20 bp, Artificial Sequence
  Description of Artificial Sequence: Synthetic oligonucleotide
ctcctgagttcaagcaatcc

SEQ ID NO: 7721 - DNA, 20 bp, Artificial Sequence
  Description of Artificial Sequence: Synthetic oligonucleotide
tcctgagttcaagcaatcct

SEQ ID NO: 7722 - DNA, 20 bp, Artificial Sequence
  Description of Artificial Sequence: Synthetic oligonucleotide
cctgagttcaagcaatcctc

SEQ ID NO: 7723 - DNA, 20 bp, Artificial Sequence
  Description of Artificial Sequence: Synthetic oligonucleotide
ctgagttcaagcaatcctcc

SEQ ID NO: 7724 - DNA, 20 bp, Artificial Sequence
  Description of Artificial Sequence: Synthetic oligonucleotide
tgagttcaagcaatcctcct

SEQ ID NO: 7725 - DNA, 20 bp, Artificial Sequence
  Description of Artificial Sequence: Synthetic oligonucleotide
gagttcaagcaatcctcctg

SEQ ID NO: 7726 - DNA, 20 bp, Artificial Sequence
  Description of Artificial Sequence: Synthetic oligonucleotide
agttcaagcaatcctcctgt

SEQ ID NO: 7727 - DNA, 20 bp, Artificial Sequence
  Description of Artificial Sequence: Synthetic oligonucleotide
gttcaagcaatcctcctgtg

SEQ ID NO: 7728 - DNA, 20 bp, Artificial Sequence
  Description of Artificial Sequence: Synthetic oligonucleotide
ttcaagcaatcctcctgtgt

SEQ ID NO: 7729 - DNA, 20 bp, Artificial Sequence
  Description of Artificial Sequence: Synthetic oligonucleotide
tcaagcaatcctcctgtgta

SEQ ID NO: 7730 - DNA, 20 bp, Artificial Sequence
  Description of Artificial Sequence: Synthetic oligonucleotide
caagcaatcctcctgtgtag

SEQ ID NO: 7731 - DNA, 20 bp, Artificial Sequence
  Description of Artificial Sequence: Synthetic oligonucleotide
aagcaatcctcctgtgtagc

SEQ ID NO: 7732 - DNA, 20 bp, Artificial Sequence
  Description of Artificial Sequence: Synthetic oligonucleotide
agcaatcctcctgtgtagca

SEQ ID NO: 7733 - DNA, 20 bp, Artificial Sequence
  Description of Artificial Sequence: Synthetic oligonucleotide
gcaatcctcctgtgtagcag

SEQ ID NO: 7734 - DNA, 20 bp, Artificial Sequence
  Description of Artificial Sequence: Synthetic oligonucleotide
caatcctcctgtgtagcagg

SEQ ID NO: 7735 - DNA, 20 bp, Artificial Sequence
  Description of Artificial Sequence: Synthetic oligonucleotide
aatcctcctgtgtagcaggg

SEQ ID NO: 7736 - DNA, 20 bp, Artificial Sequence
  Description of Artificial Sequence: Synthetic oligonucleotide
atcctcctgtgtagcaggga

SEQ ID NO: 7737 - DNA, 20 bp, Artificial Sequence
  Description of Artificial Sequence: Synthetic oligonucleotide
tcctcctgtgtagcagggat

SEQ ID NO: 7738 - DNA, 20 bp, Artificial Sequence
  Description of Artificial Sequence: Synthetic oligonucleotide
cctcctgtgtagcagggatt

SEQ ID NO: 7739 - DNA, 20 bp, Artificial Sequence
  Description of Artificial Sequence: Synthetic oligonucleotide
ctcctgtgtagcagggatta

SEQ ID NO: 7740 - DNA, 20 bp, Artificial Sequence
  Description of Artificial Sequence: Synthetic oligonucleotide
tcctgtgtagcagggattac

SEQ ID NO: 7741 - DNA, 20 bp, Artificial Sequence
  Description of Artificial Sequence: Synthetic oligonucleotide
cctgtgtagcagggattaca

SEQ ID NO: 7742 - DNA, 20 bp, Artificial Sequence
  Description of Artificial Sequence: Synthetic oligonucleotide
ctgtgtagcagggattacag

SEQ ID NO: 7743 - DNA, 20 bp, Artificial Sequence
  Description of Artificial Sequence: Synthetic oligonucleotide
tgtgtagcagggattacagg

SEQ ID NO: 7744 - DNA, 20 bp, Artificial Sequence
  Description of Artificial Sequence: Synthetic oligonucleotide
gtgtagcagggattacaggt

SEQ ID NO: 7745 - DNA, 20 bp, Artificial Sequence
  Description of Artificial Sequence: Synthetic oligonucleotide
tgtagcagggattacaggtg

SEQ ID NO: 7746 - DNA, 20 bp, Artificial Sequence
  Description of Artificial Sequence: Synthetic oligonucleotide
gtagcagggattacaggtgc

SEQ ID NO: 7747 - DNA, 20 bp, Artificial Sequence
  Description of Artificial Sequence: Synthetic oligonucleotide
tagcagggattacaggtgcc

SEQ ID NO: 7748 - DNA, 20 bp, Artificial Sequence
  Description of Artificial Sequence: Synthetic oligonucleotide
agcagggattacaggtgccc

SEQ ID NO: 7749 - DNA, 20 bp, Artificial Sequence
  Description of Artificial Sequence: Synthetic oligonucleotide
gcagggattacaggtgccca

SEQ ID NO: 7750 - DNA, 20 bp, Artificial Sequence
  Description of Artificial Sequence: Synthetic oligonucleotide
cagggattacaggtgcccac

SEQ ID NO: 7751 - DNA, 20 bp, Artificial Sequence
  Description of Artificial Sequence: Synthetic oligonucleotide
agggattacaggtgcccacc

SEQ ID NO: 7752 - DNA, 20 bp, Artificial Sequence
  Description of Artificial Sequence: Synthetic oligonucleotide
gggattacaggtgcccacca

SEQ ID NO: 7753 - DNA, 20 bp, Artificial Sequence
  Description of Artificial Sequence: Synthetic oligonucleotide
ggattacaggtgcccaccac

SEQ ID NO: 7754 - DNA, 20 bp, Artificial Sequence
  Description of Artificial Sequence: Synthetic oligonucleotide
gattacaggtgcccaccacc

SEQ ID NO: 7755 - DNA, 20 bp, Artificial Sequence
  Description of Artificial Sequence: Synthetic oligonucleotide
attacaggtgcccaccacca

SEQ ID NO: 7756 - DNA, 20 bp, Artificial Sequence
  Description of Artificial Sequence: Synthetic oligonucleotide
ttacaggtgcccaccaccat

SEQ ID NO: 7757 - DNA, 20 bp, Artificial Sequence
  Description of Artificial Sequence: Synthetic oligonucleotide
tacaggtgcccaccaccatg

SEQ ID NO: 7758 - DNA, 20 bp, Artificial Sequence
  Description of Artificial Sequence: Synthetic oligonucleotide
acaggtgcccaccaccatgc

SEQ ID NO: 7759 - DNA, 20 bp, Artificial Sequence
  Description of Artificial Sequence: Synthetic oligonucleotide
caggtgcccaccaccatgcc

SEQ ID NO: 7760 - DNA, 20 bp, Artificial Sequence
  Description of Artificial Sequence: Synthetic oligonucleotide
aggtgcccaccaccatgcct

SEQ ID NO: 7761 - DNA, 20 bp, Artificial Sequence
  Description of Artificial Sequence: Synthetic oligonucleotide
ggtgcccaccaccatgcctg

SEQ ID NO: 7762 - DNA, 20 bp, Artificial Sequence
  Description of Artificial Sequence: Synthetic oligonucleotide
gtgcccaccaccatgcctgg

SEQ ID NO: 7763 - DNA, 20 bp, Artificial Sequence
  Description of Artificial Sequence: Synthetic oligonucleotide
tgcccaccaccatgcctggc

SEQ ID NO: 7764 - DNA, 20 bp, Artificial Sequence
  Description of Artificial Sequence: Synthetic oligonucleotide
gcccaccaccatgcctggct

SEQ ID NO: 7765 - DNA, 20 bp, Artificial Sequence
  Description of Artificial Sequence: Synthetic oligonucleotide
cccaccaccatgcctggcta

SEQ ID NO: 7766 - DNA, 20 bp, Artificial Sequence
  Description of Artificial Sequence: Synthetic oligonucleotide
ccaccaccatgcctggctaa

SEQ ID NO: 7767 - DNA, 20 bp, Artificial Sequence
  Description of Artificial Sequence: Synthetic oligonucleotide
caccaccatgcctggctaat

SEQ ID NO: 7768 - DNA, 20 bp, Artificial Sequence
  Description of Artificial Sequence: Synthetic oligonucleotide
accaccatgcctggctaatt

SEQ ID NO: 7769 - DNA, 20 bp, Artificial Sequence
  Description of Artificial Sequence: Synthetic oligonucleotide
ccaccatgcctggctaattt

SEQ ID NO: 7770 - DNA, 20 bp, Artificial Sequence
  Description of Artificial Sequence: Synthetic oligonucleotide
caccatgcctggctaatttt

SEQ ID NO: 7771 - DNA, 20 bp, Artificial Sequence
  Description of Artificial Sequence: Synthetic oligonucleotide
accatgcctggctaattttt

SEQ ID NO: 7772 - DNA, 20 bp, Artificial Sequence
  Description of Artificial Sequence: Synthetic oligonucleotide
ccatgcctggctaatttttt

SEQ ID NO: 7773 - DNA, 20 bp, Artificial Sequence
  Description of Artificial Sequence: Synthetic oligonucleotide
catgcctggctaattttttt

SEQ ID NO: 7774 - DNA, 20 bp, Artificial Sequence
  Description of Artificial Sequence: Synthetic oligonucleotide
atgcctggctaatttttttg

SEQ ID NO: 7775 - DNA, 20 bp, Artificial Sequence
  Description of Artificial Sequence: Synthetic oligonucleotide
tgcctggctaatttttttgt

SEQ ID NO: 7776 - DNA, 20 bp, Artificial Sequence
  Description of Artificial Sequence: Synthetic oligonucleotide
gcctggctaatttttttgta

SEQ ID NO: 7777 - DNA, 20 bp, Artificial Sequence
  Description of Artificial Sequence: Synthetic oligonucleotide
cctggctaatttttttgtat

SEQ ID NO: 7778 - DNA, 20 bp, Artificial Sequence
  Description of Artificial Sequence: Synthetic oligonucleotide
ctggctaatttttttgtatt

SEQ ID NO: 7779 - DNA, 20 bp, Artificial Sequence
  Description of Artificial Sequence: Synthetic oligonucleotide
tggctaatttttttgtattt

SEQ ID NO: 7780 - DNA, 20 bp, Artificial Sequence
  Description of Artificial Sequence: Synthetic oligonucleotide
ggctaatttttttgtatttt

SEQ ID NO: 7781 - DNA, 20 bp, Artificial Sequence
  Description of Artificial Sequence: Synthetic oligonucleotide
gctaatttttttgtattttt

SEQ ID NO: 7782 - DNA, 20 bp, Artificial Sequence
  Description of Artificial Sequence: Synthetic oligonucleotide
ctaatttttttgtattttta

SEQ ID NO: 7783 - DNA, 20 bp, Artificial Sequence
  Description of Artificial Sequence: Synthetic oligonucleotide
taatttttttgtatttttag

SEQ ID NO: 7784 - DNA, 20 bp, Artificial Sequence
  Description of Artificial Sequence: Synthetic oligonucleotide
aatttttttgtatttttagt

SEQ ID NO: 7785 - DNA, 20 bp, Artificial Sequence
  Description of Artificial Sequence: Synthetic oligonucleotide
atttttttgtatttttagta

SEQ ID NO: 7786 - DNA, 20 bp, Artificial Sequence
  Description of Artificial Sequence: Synthetic oligonucleotide
tttttttgtatttttagtag

SEQ ID NO: 7787 - DNA, 20 bp, Artificial Sequence
  Description of Artificial Sequence: Synthetic oligonucleotide
ttttttgtatttttagtaga

SEQ ID NO: 7788 - DNA, 20 bp, Artificial Sequence
  Description of Artificial Sequence: Synthetic oligonucleotide
tttttgtatttttagtagag

SEQ ID NO: 7789 - DNA, 20 bp, Artificial Sequence
  Description of Artificial Sequence: Synthetic oligonucleotide
ttttgtatttttagtagaga

SEQ ID NO: 7790 - DNA, 20 bp, Artificial Sequence
  Description of Artificial Sequence: Synthetic oligonucleotide
tttgtatttttagtagagac

SEQ ID NO: 7791 - DNA, 20 bp, Artificial Sequence
  Description of Artificial Sequence: Synthetic oligonucleotide
ttgtatttttagtagagaca

SEQ ID NO: 7792 - DNA, 20 bp, Artificial Sequence
  Description of Artificial Sequence: Synthetic oligonucleotide
tgtatttttagtagagacag

SEQ ID NO: 7793 - DNA, 20 bp, Artificial Sequence
  Description of Artificial Sequence: Synthetic oligonucleotide
gtatttttagtagagacagg

SEQ ID NO: 7794 - DNA, 20 bp, Artificial Sequence
  Description of Artificial Sequence: Synthetic oligonucleotide
tatttttagtagagacaggg

SEQ ID NO: 7795 - DNA, 20 bp, Artificial Sequence
  Description of Artificial Sequence: Synthetic oligonucleotide
atttttagtagagacagggt

SEQ ID NO: 7796 - DNA, 20 bp, Artificial Sequence
  Description of Artificial Sequence: Synthetic oligonucleotide
tttttagtagagacagggtt

SEQ ID NO: 7797 - DNA, 20 bp, Artificial Sequence
  Description of Artificial Sequence: Synthetic oligonucleotide
ttttagtagagacagggttt

SEQ ID NO: 7798 - DNA, 20 bp, Artificial Sequence
  Description of Artificial Sequence: Synthetic oligonucleotide
tttagtagagacagggtttc

SEQ ID NO: 7799 - DNA, 20 bp, Artificial Sequence
  Description of Artificial Sequence: Synthetic oligonucleotide
ttagtagagacagggtttca

SEQ ID NO: 7800 - DNA, 20 bp, Artificial Sequence
  Description of Artificial Sequence: Synthetic oligonucleotide
tagtagagacagggtttcac

SEQ ID NO: 7801 - DNA, 20 bp, Artificial Sequence
  Description of Artificial Sequence: Synthetic oligonucleotide
agtagagacagggtttcacc

SEQ ID NO: 7802 - DNA, 20 bp, Artificial Sequence
  Description of Artificial Sequence: Synthetic oligonucleotide
gtagagacagggtttcacca

SEQ ID NO: 7803 - DNA, 20 bp, Artificial Sequence
  Description of Artificial Sequence: Synthetic oligonucleotide
tagagacagggtttcaccat

SEQ ID NO: 7804 - DNA, 20 bp, Artificial Sequence
  Description of Artificial Sequence: Synthetic oligonucleotide
agagacagggtttcaccatg

SEQ ID NO: 7805 - DNA, 20 bp, Artificial Sequence
  Description of Artificial Sequence: Synthetic oligonucleotide
gagacagggtttcaccatgt

SEQ ID NO: 7806 - DNA, 20 bp, Artificial Sequence
  Description of Artificial Sequence: Synthetic oligonucleotide
agacagggtttcaccatgtt

SEQ ID NO: 7807 - DNA, 20 bp, Artificial Sequence
  Description of Artificial Sequence: Synthetic oligonucleotide
gacagggtttcaccatgttg

SEQ ID NO: 7808 - DNA, 20 bp, Artificial Sequence
  Description of Artificial Sequence: Synthetic oligonucleotide
acagggtttcaccatgttgg

SEQ ID NO: 7809 - DNA, 20 bp, Artificial Sequence
  Description of Artificial Sequence: Synthetic oligonucleotide
cagggtttcaccatgttggc

SEQ ID NO: 7810 - DNA, 20 bp, Artificial Sequence
  Description of Artificial Sequence: Synthetic oligonucleotide
agggtttcaccatgttggcc

SEQ ID NO: 7811 - DNA, 20 bp, Artificial Sequence
  Description of Artificial Sequence: Synthetic oligonucleotide
gggtttcaccatgttggcca

SEQ ID NO: 7812 - DNA, 20 bp, Artificial Sequence
  Description of Artificial Sequence: Synthetic oligonucleotide
ggtttcaccatgttggccag

SEQ ID NO: 7813 - DNA, 20 bp, Artificial Sequence
  Description of Artificial Sequence: Synthetic oligonucleotide
gtttcaccatgttggccagg

SEQ ID NO: 7814 - DNA, 20 bp, Artificial Sequence
  Description of Artificial Sequence: Synthetic oligonucleotide
tttcaccatgttggccaggc

SEQ ID NO: 7815 - DNA, 20 bp, Artificial Sequence
  Description of Artificial Sequence: Synthetic oligonucleotide
ttcaccatgttggccaggct

SEQ ID NO: 7816 - DNA, 20 bp, Artificial Sequence
  Description of Artificial Sequence: Synthetic oligonucleotide
tcaccatgttggccaggctg

SEQ ID NO: 7817 - DNA, 20 bp, Artificial Sequence
  Description of Artificial Sequence: Synthetic oligonucleotide
caccatgttggccaggctgg

SEQ ID NO: 7818 - DNA, 20 bp, Artificial Sequence
  Description of Artificial Sequence: Synthetic oligonucleotide
accatgttggccaggctggt

SEQ ID NO: 7819 - DNA, 20 bp, Artificial Sequence
  Description of Artificial Sequence: Synthetic oligonucleotide
ccatgttggccaggctggtc

SEQ ID NO: 7820 - DNA, 20 bp, Artificial Sequence
  Description of Artificial Sequence: Synthetic oligonucleotide
catgttggccaggctggtct

SEQ ID NO: 7821 - DNA, 20 bp, Artificial Sequence
  Description of Artificial Sequence: Synthetic oligonucleotide
atgttggccaggctggtctt

SEQ ID NO: 7822 - DNA, 20 bp, Artificial Sequence
  Description of Artificial Sequence: Synthetic oligonucleotide
tgttggccaggctggtctta

SEQ ID NO: 7823 - DNA, 20 bp, Artificial Sequence
  Description of Artificial Sequence: Synthetic oligonucleotide
gttggccaggctggtcttaa

SEQ ID NO: 7824 - DNA, 20 bp, Artificial Sequence
  Description of Artificial Sequence: Synthetic oligonucleotide
ttggccaggctggtcttaaa

SEQ ID NO: 7825 - DNA, 20 bp, Artificial Sequence
  Description of Artificial Sequence: Synthetic oligonucleotide
tggccaggctggtcttaaac

SEQ ID NO: 7826 - DNA, 20 bp, Artificial Sequence
  Description of Artificial Sequence: Synthetic oligonucleotide
ggccaggctggtcttaaact

SEQ ID NO: 7827 - DNA, 20 bp, Artificial Sequence
  Description of Artificial Sequence: Synthetic oligonucleotide
gccaggctggtcttaaactc

SEQ ID NO: 7828 - DNA, 20 bp, Artificial Sequence
  Description of Artificial Sequence: Synthetic oligonucleotide
ccaggctggtcttaaactcc

SEQ ID NO: 7829 - DNA, 20 bp, Artificial Sequence
  Description of Artificial Sequence: Synthetic oligonucleotide
caggctggtcttaaactcct

SEQ ID NO: 7830 - DNA, 20 bp, Artificial Sequence
  Description of Artificial Sequence: Synthetic oligonucleotide
aggctggtcttaaactcctg

SEQ ID NO: 7831 - DNA, 20 bp, Artificial Sequence
  Description of Artificial Sequence: Synthetic oligonucleotide
ggctggtcttaaactcctga

SEQ ID NO: 7832 - DNA, 20 bp, Artificial Sequence
  Description of Artificial Sequence: Synthetic oligonucleotide
gctggtcttaaactcctgac

SEQ ID NO: 7833 - DNA, 20 bp, Artificial Sequence
  Description of Artificial Sequence: Synthetic oligonucleotide
ctggtcttaaactcctgacc

SEQ ID NO: 7834 - DNA, 20 bp, Artificial Sequence
  Description of Artificial Sequence: Synthetic oligonucleotide
tggtcttaaactcctgacct

SEQ ID NO: 7835 - DNA, 20 bp, Artificial Sequence
  Description of Artificial Sequence: Synthetic oligonucleotide
ggtcttaaactcctgacctg

SEQ ID NO: 7836 - DNA, 20 bp, Artificial Sequence
  Description of Artificial Sequence: Synthetic oligonucleotide
gtcttaaactcctgacctga

SEQ ID NO: 7837 - DNA, 20 bp, Artificial Sequence
  Description of Artificial Sequence: Synthetic oligonucleotide
tcttaaactcctgacctgaa

SEQ ID NO: 7838 - DNA, 20 bp, Artificial Sequence
  Description of Artificial Sequence: Synthetic oligonucleotide
cttaaactcctgacctgaag

SEQ ID NO: 7839 - DNA, 20 bp, Artificial Sequence
  Description of Artificial Sequence: Synthetic oligonucleotide
ttaaactcctgacctgaagt

SEQ ID NO: 7840 - DNA, 20 bp, Artificial Sequence
  Description of Artificial Sequence: Synthetic oligonucleotide
taaactcctgacctgaagtg

SEQ ID NO: 7841 - DNA, 20 bp, Artificial Sequence
  Description of Artificial Sequence: Synthetic oligonucleotide
aaactcctgacctgaagtga

SEQ ID NO: 7842 - DNA, 20 bp, Artificial Sequence
  Description of Artificial Sequence: Synthetic oligonucleotide
aactcctgacctgaagtgat

SEQ ID NO: 7843 - DNA, 20 bp, Artificial Sequence
  Description of Artificial Sequence: Synthetic oligonucleotide
actcctgacctgaagtgatc

SEQ ID NO: 7844 - DNA, 20 bp, Artificial Sequence
  Description of Artificial Sequence: Synthetic oligonucleotide
ctcctgacctgaagtgatcc

SEQ ID NO: 7845 - DNA, 20 bp, Artificial Sequence
  Description of Artificial Sequence: Synthetic oligonucleotide
tcctgacctgaagtgatcca

SEQ ID NO: 7846 - DNA, 20 bp, Artificial Sequence
  Description of Artificial Sequence: Synthetic oligonucleotide
cctgacctgaagtgatccac

SEQ ID NO: 7847 - DNA, 20 bp, Artificial Sequence
  Description of Artificial Sequence: Synthetic oligonucleotide
ctgacctgaagtgatccacc

SEQ ID NO: 7848 - DNA, 20 bp, Artificial Sequence
  Description of Artificial Sequence: Synthetic oligonucleotide
tgacctgaagtgatccacct

SEQ ID NO: 7849 - DNA, 20 bp, Artificial Sequence
  Description of Artificial Sequence: Synthetic oligonucleotide
gacctgaagtgatccacctg

SEQ ID NO: 7850 - DNA, 20 bp, Artificial Sequence
  Description of Artificial Sequence: Synthetic oligonucleotide
acctgaagtgatccacctgc

SEQ ID NO: 7851 - DNA, 20 bp, Artificial Sequence
  Description of Artificial Sequence: Synthetic oligonucleotide
cctgaagtgatccacctgcc

SEQ ID NO: 7852 - DNA, 20 bp, Artificial Sequence
  Description of Artificial Sequence: Synthetic oligonucleotide
ctgaagtgatccacctgcct

SEQ ID NO: 7853 - DNA, 20 bp, Artificial Sequence
  Description of Artificial Sequence: Synthetic oligonucleotide
tgaagtgatccacctgcctc

SEQ ID NO: 7854 - DNA, 20 bp, Artificial Sequence
  Description of Artificial Sequence: Synthetic oligonucleotide
gaagtgatccacctgcctcg

SEQ ID NO: 7855 - DNA, 20 bp, Artificial Sequence
  Description of Artificial Sequence: Synthetic oligonucleotide
aagtgatccacctgcctcgg

SEQ ID NO: 7856 - DNA, 20 bp, Artificial Sequence
  Description of Artificial Sequence: Synthetic oligonucleotide
agtgatccacctgcctcggc

SEQ ID NO: 7857 - DNA, 20 bp, Artificial Sequence
  Description of Artificial Sequence: Synthetic oligonucleotide
gtgatccacctgcctcggcc

SEQ ID NO: 7858 - DNA, 20 bp, Artificial Sequence
  Description of Artificial Sequence: Synthetic oligonucleotide
tgatccacctgcctcggcct

SEQ ID NO: 7859 - DNA, 20 bp, Artificial Sequence
  Description of Artificial Sequence: Synthetic oligonucleotide
gatccacctgcctcggcctc

SEQ ID NO: 7860 - DNA, 20 bp, Artificial Sequence
  Description of Artificial Sequence: Synthetic oligonucleotide
atccacctgcctcggcctcc

SEQ ID NO: 7861 - DNA, 20 bp, Artificial Sequence
  Description of Artificial Sequence: Synthetic oligonucleotide
tccacctgcctcggcctccc

SEQ ID NO: 7862 - DNA, 20 bp, Artificial Sequence
  Description of Artificial Sequence: Synthetic oligonucleotide
ccacctgcctcggcctccca

SEQ ID NO: 7863 - DNA, 20 bp, Artificial Sequence
  Description of Artificial Sequence: Synthetic oligonucleotide
cacctgcctcggcctcccat

SEQ ID NO: 7864 - DNA, 20 bp, Artificial Sequence
  Description of Artificial Sequence: Synthetic oligonucleotide
acctgcctcggcctcccata

SEQ ID NO: 7865 - DNA, 20 bp, Artificial Sequence
  Description of Artificial Sequence: Synthetic oligonucleotide
cctgcctcggcctcccatag

SEQ ID NO: 7866 - DNA, 20 bp, Artificial Sequence
  Description of Artificial Sequence: Synthetic oligonucleotide
ctgcctcggcctcccatagt

SEQ ID NO: 7867 - DNA, 20 bp, Artificial Sequence
  Description of Artificial Sequence: Synthetic oligonucleotide
tgcctcggcctcccatagtg

SEQ ID NO: 7868 - DNA, 20 bp, Artificial Sequence
  Description of Artificial Sequence: Synthetic oligonucleotide
gcctcggcctcccatagtgc

SEQ ID NO: 7869 - DNA, 20 bp, Artificial Sequence
  Description of Artificial Sequence: Synthetic oligonucleotide
cctcggcctcccatagtgct

SEQ ID NO: 7870 - DNA, 20 bp, Artificial Sequence
  Description of Artificial Sequence: Synthetic oligonucleotide
ctcggcctcccatagtgctg

SEQ ID NO: 7871 - DNA, 20 bp, Artificial Sequence
  Description of Artificial Sequence: Synthetic oligonucleotide
tcggcctcccatagtgctgg

SEQ ID NO: 7872 - DNA, 20 bp, Artificial Sequence
  Description of Artificial Sequence: Synthetic oligonucleotide
cggcctcccatagtgctggg

SEQ ID NO: 7873 - DNA, 20 bp, Artificial Sequence
  Description of Artificial Sequence: Synthetic oligonucleotide
ggcctcccatagtgctggga

SEQ ID NO: 7874 - DNA, 20 bp, Artificial Sequence
  Description of Artificial Sequence: Synthetic oligonucleotide
gcctcccatagtgctgggat

SEQ ID NO: 7875 - DNA, 20 bp, Artificial Sequence
  Description of Artificial Sequence: Synthetic oligonucleotide
cctcccatagtgctgggatt

SEQ ID NO: 7876 - DNA, 20 bp, Artificial Sequence
  Description of Artificial Sequence: Synthetic oligonucleotide
ctcccatagtgctgggatta

SEQ ID NO: 7877 - DNA, 20 bp, Artificial Sequence
  Description of Artificial Sequence: Synthetic oligonucleotide
tcccatagtgctgggattac

SEQ ID NO: 7878 - DNA, 20 bp, Artificial Sequence
  Description of Artificial Sequence: Synthetic oligonucleotide
cccatagtgctgggattaca

SEQ ID NO: 7879 - DNA, 20 bp, Artificial Sequence
  Description of Artificial Sequence: Synthetic oligonucleotide
ccatagtgctgggattacag

SEQ ID NO: 7880 - DNA, 20 bp, Artificial Sequence
  Description of Artificial Sequence: Synthetic oligonucleotide
catagtgctgggattacagg

SEQ ID NO: 7881 - DNA, 20 bp, Artificial Sequence
  Description of Artificial Sequence: Synthetic oligonucleotide
atagtgctgggattacaggt

SEQ ID NO: 7882 - DNA, 20 bp, Artificial Sequence
  Description of Artificial Sequence: Synthetic oligonucleotide
tagtgctgggattacaggtg

SEQ ID NO: 7883 - DNA, 20 bp, Artificial Sequence
  Description of Artificial Sequence: Synthetic oligonucleotide
agtgctgggattacaggtgt

SEQ ID NO: 7884 - DNA, 20 bp, Artificial Sequence
  Description of Artificial Sequence: Synthetic oligonucleotide
gtgctgggattacaggtgtg

SEQ ID NO: 7885 - DNA, 20 bp, Artificial Sequence
  Description of Artificial Sequence: Synthetic oligonucleotide
tgctgggattacaggtgtga

SEQ ID NO: 7886 - DNA, 20 bp, Artificial Sequence
  Description of Artificial Sequence: Synthetic oligonucleotide
gctgggattacaggtgtgag

SEQ ID NO: 7887 - DNA, 20 bp, Artificial Sequence
  Description of Artificial Sequence: Synthetic oligonucleotide
ctgggattacaggtgtgagc

SEQ ID NO: 7888 - DNA, 20 bp, Artificial Sequence
  Description of Artificial Sequence: Synthetic oligonucleotide
tgggattacaggtgtgagcc

SEQ ID NO: 7889 - DNA, 20 bp, Artificial Sequence
  Description of Artificial Sequence: Synthetic oligonucleotide
gggattacaggtgtgagcca

SEQ ID NO: 7890 - DNA, 20 bp, Artificial Sequence
  Description of Artificial Sequence: Synthetic oligonucleotide
ggattacaggtgtgagccac

SEQ ID NO: 7891 - DNA, 20 bp, Artificial Sequence
  Description of Artificial Sequence: Synthetic oligonucleotide
gattacaggtgtgagccact

SEQ ID NO: 7892 - DNA, 20 bp, Artificial Sequence
  Description of Artificial Sequence: Synthetic oligonucleotide
attacaggtgtgagccactg

SEQ ID NO: 7893 - DNA, 20 bp, Artificial Sequence
  Description of Artificial Sequence: Synthetic oligonucleotide
ttacaggtgtgagccactgc

SEQ ID NO: 7894 - DNA, 20 bp, Artificial Sequence
  Description of Artificial Sequence: Synthetic oligonucleotide
tacaggtgtgagccactgcg

SEQ ID NO: 7895 - DNA, 20 bp, Artificial Sequence
  Description of Artificial Sequence: Synthetic oligonucleotide
acaggtgtgagccactgcgc

SEQ ID NO: 7896 - DNA, 20 bp, Artificial Sequence
  Description of Artificial Sequence: Synthetic oligonucleotide
caggtgtgagccactgcgcc

SEQ ID NO: 7897 - DNA, 20 bp, Artificial Sequence
  Description of Artificial Sequence: Synthetic oligonucleotide
aggtgtgagccactgcgccc

SEQ ID NO: 7898 - DNA, 20 bp, Artificial Sequence
  Description of Artificial Sequence: Synthetic oligonucleotide
ggtgtgagccactgcgccca

SEQ ID NO: 7899 - DNA, 20 bp, Artificial Sequence
  Description of Artificial Sequence: Synthetic oligonucleotide
gtgtgagccactgcgcccag

SEQ ID NO: 7900 - DNA, 20 bp, Artificial Sequence
  Description of Artificial Sequence: Synthetic oligonucleotide
tgtgagccactgcgcccagc

SEQ ID NO: 7901 - DNA, 20 bp, Artificial Sequence
  Description of Artificial Sequence: Synthetic oligonucleotide
gtgagccactgcgcccagcc

SEQ ID NO: 7902 - DNA, 20 bp, Artificial Sequence
  Description of Artificial Sequence: Synthetic oligonucleotide
tgagccactgcgcccagccg

SEQ ID NO: 7903 - DNA, 20 bp, Artificial Sequence
  Description of Artificial Sequence: Synthetic oligonucleotide
gagccactgcgcccagccga

SEQ ID NO: 7904 - DNA, 20 bp, Artificial Sequence
  Description of Artificial Sequence: Synthetic oligonucleotide
agccactgcgcccagccgaa

SEQ ID NO: 7905 - DNA, 20 bp, Artificial Sequence
  Description of Artificial Sequence: Synthetic oligonucleotide
gccactgcgcccagccgaat

SEQ ID NO: 7906 - DNA, 20 bp, Artificial Sequence
  Description of Artificial Sequence: Synthetic oligonucleotide
ccactgcgcccagccgaatt

SEQ ID NO: 7907 - DNA, 20 bp, Artificial Sequence
  Description of Artificial Sequence: Synthetic oligonucleotide
cactgcgcccagccgaattt

SEQ ID NO: 7908 - DNA, 20 bp, Artificial Sequence
  Description of Artificial Sequence: Synthetic oligonucleotide
actgcgcccagccgaatttt

SEQ ID NO: 7909 - DNA, 20 bp, Artificial Sequence
  Description of Artificial Sequence: Synthetic oligonucleotide
ctgcgcccagccgaattttc

SEQ ID NO: 7910 - DNA, 20 bp, Artificial Sequence
  Description of Artificial Sequence: Synthetic oligonucleotide
tgcgcccagccgaattttcc

SEQ ID NO: 7911 - DNA, 20 bp, Artificial Sequence
  Description of Artificial Sequence: Synthetic oligonucleotide
gcgcccagccgaattttcct

SEQ ID NO: 7912 - DNA, 20 bp, Artificial Sequence
  Description of Artificial Sequence: Synthetic oligonucleotide
cgcccagccgaattttcctt

SEQ ID NO: 7913 - DNA, 20 bp, Artificial Sequence
  Description of Artificial Sequence: Synthetic oligonucleotide
gcccagccgaattttccttt

SEQ ID NO: 7914 - DNA, 20 bp, Artificial Sequence
  Description of Artificial Sequence: Synthetic oligonucleotide
cccagccgaattttcctttc

SEQ ID NO: 7915 - DNA, 20 bp, Artificial Sequence
  Description of Artificial Sequence: Synthetic oligonucleotide
ccagccgaattttcctttct

SEQ ID NO: 7916 - DNA, 20 bp, Artificial Sequence
  Description of Artificial Sequence: Synthetic oligonucleotide
cagccgaattttcctttctt

SEQ ID NO: 7917 - DNA, 20 bp, Artificial Sequence
  Description of Artificial Sequence: Synthetic oligonucleotide
agccgaattttcctttcttt

SEQ ID NO: 7918 - DNA, 20 bp, Artificial Sequence
  Description of Artificial Sequence: Synthetic oligonucleotide
gccgaattttcctttcttta

SEQ ID NO: 7919 - DNA, 20 bp, Artificial Sequence
  Description of Artificial Sequence: Synthetic oligonucleotide
ccgaattttcctttctttaa

SEQ ID NO: 7920 - DNA, 20 bp, Artificial Sequence
  Description of Artificial Sequence: Synthetic oligonucleotide
cgaattttcctttctttaaa

SEQ ID NO: 7921 - DNA, 20 bp, Artificial Sequence
  Description of Artificial Sequence: Synthetic oligonucleotide
gaattttcctttctttaaac

SEQ ID NO: 7922 - DNA, 20 bp, Artificial Sequence
  Description of Artificial Sequence: Synthetic oligonucleotide
aattttcctttctttaaact

SEQ ID NO: 7923 - DNA, 20 bp, Artificial Sequence
  Description of Artificial Sequence: Synthetic oligonucleotide
attttcctttctttaaactg

SEQ ID NO: 7924 - DNA, 20 bp, Artificial Sequence
  Description of Artificial Sequence: Synthetic oligonucleotide
ttttcctttctttaaactgt

SEQ ID NO: 7925 - DNA, 20 bp, Artificial Sequence
  Description of Artificial Sequence: Synthetic oligonucleotide
tttcctttctttaaactgtg

SEQ ID NO: 7926 - DNA, 20 bp, Artificial Sequence
  Description of Artificial Sequence: Synthetic oligonucleotide
ttcctttctttaaactgtga

SEQ ID NO: 7927 - DNA, 20 bp, Artificial Sequence
  Description of Artificial Sequence: Synthetic oligonucleotide
tcctttctttaaactgtgaa

SEQ ID NO: 7928 - DNA, 20 bp, Artificial Sequence
  Description of Artificial Sequence: Synthetic oligonucleotide
cctttctttaaactgtgaat

SEQ ID NO: 7929 - DNA, 20 bp, Artificial Sequence
  Description of Artificial Sequence: Synthetic oligonucleotide
ctttctttaaactgtgaatg

SEQ ID NO: 7930 - DNA, 20 bp, Artificial Sequence
  Description of Artificial Sequence: Synthetic oligonucleotide
tttctttaaactgtgaatgg

SEQ ID NO: 7931 - DNA, 20 bp, Artificial Sequence
  Description of Artificial Sequence: Synthetic oligonucleotide
ttctttaaactgtgaatggc

SEQ ID NO: 7932 - DNA, 20 bp, Artificial Sequence
  Description of Artificial Sequence: Synthetic oligonucleotide
tctttaaactgtgaatggcc

SEQ ID NO: 7933 - DNA, 20 bp, Artificial Sequence
  Description of Artificial Sequence: Synthetic oligonucleotide
ctttaaactgtgaatggccc

SEQ ID NO: 7934 - DNA, 20 bp, Artificial Sequence
  Description of Artificial Sequence: Synthetic oligonucleotide
tttaaactgtgaatggccct

SEQ ID NO: 7935 - DNA, 20 bp, Artificial Sequence
  Description of Artificial Sequence: Synthetic oligonucleotide
ttaaactgtgaatggccctg

SEQ ID NO: 7936 - DNA, 20 bp, Artificial Sequence
  Description of Artificial Sequence: Synthetic oligonucleotide
taaactgtgaatggccctgt

SEQ ID NO: 7937 - DNA, 20 bp, Artificial Sequence
  Description of Artificial Sequence: Synthetic oligonucleotide
aaactgtgaatggccctgtt

SEQ ID NO: 7938 - DNA, 20 bp, Artificial Sequence
  Description of Artificial Sequence: Synthetic oligonucleotide
aactgtgaatggccctgttg

SEQ ID NO: 7939 - DNA, 20 bp, Artificial Sequence
  Description of Artificial Sequence: Synthetic oligonucleotide
actgtgaatggccctgttgt

SEQ ID NO: 7940 - DNA, 20 bp, Artificial Sequence
  Description of Artificial Sequence: Synthetic oligonucleotide
ctgtgaatggccctgttgtt

SEQ ID NO: 7941 - DNA, 20 bp, Artificial Sequence
  Description of Artificial Sequence: Synthetic oligonucleotide
tgtgaatggccctgttgttg

SEQ ID NO: 7942 - DNA, 20 bp, Artificial Sequence
  Description of Artificial Sequence: Synthetic oligonucleotide
gtgaatggccctgttgttgt

SEQ ID NO: 7943 - DNA, 20 bp, Artificial Sequence
  Description of Artificial Sequence: Synthetic oligonucleotide
tgaatggccctgttgttgta

SEQ ID NO: 7944 - DNA, 20 bp, Artificial Sequence
  Description of Artificial Sequence: Synthetic oligonucleotide
gaatggccctgttgttgtag

SEQ ID NO: 7945 - DNA, 20 bp, Artificial Sequence
  Description of Artificial Sequence: Synthetic oligonucleotide
aatggccctgttgttgtagt

SEQ ID NO: 7946 - DNA, 20 bp, Artificial Sequence
  Description of Artificial Sequence: Synthetic oligonucleotide
atggccctgttgttgtagtc

SEQ ID NO: 7947 - DNA, 20 bp, Artificial Sequence
  Description of Artificial Sequence: Synthetic oligonucleotide
tggccctgttgttgtagtcc

SEQ ID NO: 7948 - DNA, 20 bp, Artificial Sequence
  Description of Artificial Sequence: Synthetic oligonucleotide
ggccctgttgttgtagtccc

SEQ ID NO: 7949 - DNA, 20 bp, Artificial Sequence
  Description of Artificial Sequence: Synthetic oligonucleotide
gccctgttgttgtagtcccc

SEQ ID NO: 7950 - DNA, 20 bp, Artificial Sequence
  Description of Artificial Sequence: Synthetic oligonucleotide
ccctgttgttgtagtcccct

SEQ ID NO: 7951 - DNA, 20 bp, Artificial Sequence
  Description of Artificial Sequence: Synthetic oligonucleotide
cctgttgttgtagtcccctt

SEQ ID NO: 7952 - DNA, 20 bp, Artificial Sequence
  Description of Artificial Sequence: Synthetic oligonucleotide
ctgttgttgtagtccccttg

SEQ ID NO: 7953 - DNA, 20 bp, Artificial Sequence
  Description of Artificial Sequence: Synthetic oligonucleotide
tgttgttgtagtccccttga

SEQ ID NO: 7954 - DNA, 20 bp, Artificial Sequence
  Description of Artificial Sequence: Synthetic oligonucleotide
gttgttgtagtccccttgag

SEQ ID NO: 7955 - DNA, 20 bp, Artificial Sequence
  Description of Artificial Sequence: Synthetic oligonucleotide
ttgttgtagtccccttgagg

SEQ ID NO: 7956 - DNA, 20 bp, Artificial Sequence
  Description of Artificial Sequence: Synthetic oligonucleotide
tgttgtagtccccttgaggg

SEQ ID NO: 7957 - DNA, 20 bp, Artificial Sequence
  Description of Artificial Sequence: Synthetic oligonucleotide
gttgtagtccccttgagggg

SEQ ID NO: 7958 - DNA, 20 bp, Artificial Sequence
  Description of Artificial Sequence: Synthetic oligonucleotide
ttgtagtccccttgaggggg

SEQ ID NO: 7959 - DNA, 20 bp, Artificial Sequence
  Description of Artificial Sequence: Synthetic oligonucleotide
tgtagtccccttgagggggt

SEQ ID NO: 7960 - DNA, 20 bp, Artificial Sequence
  Description of Artificial Sequence: Synthetic oligonucleotide
gtagtccccttgagggggtg

SEQ ID NO: 7961 - DNA, 20 bp, Artificial Sequence
  Description of Artificial Sequence: Synthetic oligonucleotide
tagtccccttgagggggtga

SEQ ID NO: 7962 - DNA, 20 bp, Artificial Sequence
  Description of Artificial Sequence: Synthetic oligonucleotide
agtccccttgagggggtgaa

SEQ ID NO: 7963 - DNA, 20 bp, Artificial Sequence
  Description of Artificial Sequence: Synthetic oligonucleotide
gtccccttgagggggtgaag

SEQ ID NO: 7964 - DNA, 20 bp, Artificial Sequence
  Description of Artificial Sequence: Synthetic oligonucleotide
tccccttgagggggtgaagg

SEQ ID NO: 7965 - DNA, 20 bp, Artificial Sequence
  Description of Artificial Sequence: Synthetic oligonucleotide
ccccttgagggggtgaagga

SEQ ID NO: 7966 - DNA, 20 bp, Artificial Sequence
  Description of Artificial Sequence: Synthetic oligonucleotide
cccttgagggggtgaaggac

SEQ ID NO: 7967 - DNA, 20 bp, Artificial Sequence
  Description of Artificial Sequence: Synthetic oligonucleotide
ccttgagggggtgaaggaca

SEQ ID NO: 7968 - DNA, 20 bp, Artificial Sequence
  Description of Artificial Sequence: Synthetic oligonucleotide
cttgagggggtgaaggacag

SEQ ID NO: 7969 - DNA, 20 bp, Artificial Sequence
  Description of Artificial Sequence: Synthetic oligonucleotide
ttgagggggtgaaggacagg

SEQ ID NO: 7970 - DNA, 20 bp, Artificial Sequence
  Description of Artificial Sequence: Synthetic oligonucleotide
tgagggggtgaaggacaggt

SEQ ID NO: 7971 - DNA, 20 bp, Artificial Sequence
  Description of Artificial Sequence: Synthetic oligonucleotide
gagggggtgaaggacaggta

SEQ ID NO: 7972 - DNA, 20 bp, Artificial Sequence
  Description of Artificial Sequence: Synthetic oligonucleotide
agggggtgaaggacaggtat

SEQ ID NO: 7973 - DNA, 20 bp, Artificial Sequence
  Description of Artificial Sequence: Synthetic oligonucleotide
gggggtgaaggacaggtatt

SEQ ID NO: 7974 - DNA, 20 bp, Artificial Sequence
  Description of Artificial Sequence: Synthetic oligonucleotide
ggggtgaaggacaggtatta

SEQ ID NO: 7975 - DNA, 20 bp, Artificial Sequence
  Description of Artificial Sequence: Synthetic oligonucleotide
gggtgaaggacaggtattag

SEQ ID NO: 7976 - DNA, 20 bp, Artificial Sequence
  Description of Artificial Sequence: Synthetic oligonucleotide
ggtgaaggacaggtattagg

SEQ ID NO: 7977 - DNA, 20 bp, Artificial Sequence
  Description of Artificial Sequence: Synthetic oligonucleotide
gtgaaggacaggtattaggg

SEQ ID NO: 7978 - DNA, 20 bp, Artificial Sequence
  Description of Artificial Sequence: Synthetic oligonucleotide
tgaaggacaggtattagggc

SEQ ID NO: 7979 - DNA, 20 bp, Artificial Sequence
  Description of Artificial Sequence: Synthetic oligonucleotide
gaaggacaggtattagggca

SEQ ID NO: 7980 - DNA, 20 bp, Artificial Sequence
  Description of Artificial Sequence: Synthetic oligonucleotide
aaggacaggtattagggcat

SEQ ID NO: 7981 - DNA, 20 bp, Artificial Sequence
  Description of Artificial Sequence: Synthetic oligonucleotide
aggacaggtattagggcatg

SEQ ID NO: 7982 - DNA, 20 bp, Artificial Sequence
  Description of Artificial Sequence: Synthetic oligonucleotide
ggacaggtattagggcatgg

SEQ ID NO: 7983 - DNA, 20 bp, Artificial Sequence
  Description of Artificial Sequence: Synthetic oligonucleotide
gacaggtattagggcatggc

SEQ ID NO: 7984 - DNA, 20 bp, Artificial Sequence
  Description of Artificial Sequence: Synthetic oligonucleotide
acaggtattagggcatggcc

SEQ ID NO: 7985 - DNA, 20 bp, Artificial Sequence
  Description of Artificial Sequence: Synthetic oligonucleotide
caggtattagggcatggcca

SEQ ID NO: 7986 - DNA, 20 bp, Artificial Sequence
  Description of Artificial Sequence: Synthetic oligonucleotide
aggtattagggcatggccag

SEQ ID NO: 7987 - DNA, 20 bp, Artificial Sequence
  Description of Artificial Sequence: Synthetic oligonucleotide
ggtattagggcatggccagt

SEQ ID NO: 7988 - DNA, 20 bp, Artificial Sequence
  Description of Artificial Sequence: Synthetic oligonucleotide
gtattagggcatggccagtg

SEQ ID NO: 7989 - DNA, 20 bp, Artificial Sequence
  Description of Artificial Sequence: Synthetic oligonucleotide
tattagggcatggccagtga

SEQ ID NO: 7990 - DNA, 20 bp, Artificial Sequence
  Description of Artificial Sequence: Synthetic oligonucleotide
attagggcatggccagtgac

SEQ ID NO: 7991 - DNA, 20 bp, Artificial Sequence
  Description of Artificial Sequence: Synthetic oligonucleotide
ttagggcatggccagtgact

SEQ ID NO: 7992 - DNA, 20 bp, Artificial Sequence
  Description of Artificial Sequence: Synthetic oligonucleotide
tagggcatggccagtgactg

SEQ ID NO: 7993 - DNA, 20 bp, Artificial Sequence
  Description of Artificial Sequence: Synthetic oligonucleotide
agggcatggccagtgactgt

SEQ ID NO: 7994 - DNA, 20 bp, Artificial Sequence
  Description of Artificial Sequence: Synthetic oligonucleotide
gggcatggccagtgactgta

SEQ ID NO: 7995 - DNA, 20 bp, Artificial Sequence
  Description of Artificial Sequence: Synthetic oligonucleotide
ggcatggccagtgactgtaa

SEQ ID NO: 7996 - DNA, 20 bp, Artificial Sequence
  Description of Artificial Sequence: Synthetic oligonucleotide
gcatggccagtgactgtaat

SEQ ID NO: 7997 - DNA, 20 bp, Artificial Sequence
  Description of Artificial Sequence: Synthetic oligonucleotide
catggccagtgactgtaatg

SEQ ID NO: 7998 - DNA, 20 bp, Artificial Sequence
  Description of Artificial Sequence: Synthetic oligonucleotide
atggccagtgactgtaatga

SEQ ID NO: 7999 - DNA, 20 bp, Artificial Sequence
  Description of Artificial Sequence: Synthetic oligonucleotide
tggccagtgactgtaatgac

SEQ ID NO: 8000 - DNA, 20 bp, Artificial Sequence
  Description of Artificial Sequence: Synthetic oligonucleotide
ggccagtgactgtaatgacc

SEQ ID NO: 8001 - DNA, 20 bp, Artificial Sequence
  Description of Artificial Sequence: Synthetic oligonucleotide
gccagtgactgtaatgacct

SEQ ID NO: 8002 - DNA, 20 bp, Artificial Sequence
  Description of Artificial Sequence: Synthetic oligonucleotide
ccagtgactgtaatgacctc

SEQ ID NO: 8003 - DNA, 20 bp, Artificial Sequence
  Description of Artificial Sequence: Synthetic oligonucleotide
cagtgactgtaatgacctca

SEQ ID NO: 8004 - DNA, 20 bp, Artificial Sequence
  Description of Artificial Sequence: Synthetic oligonucleotide
agtgactgtaatgacctcac

SEQ ID NO: 8005 - DNA, 20 bp, Artificial Sequence
  Description of Artificial Sequence: Synthetic oligonucleotide
gtgactgtaatgacctcacc

SEQ ID NO: 8006 - DNA, 20 bp, Artificial Sequence
  Description of Artificial Sequence: Synthetic oligonucleotide
tgactgtaatgacctcacct

SEQ ID NO: 8007 - DNA, 20 bp, Artificial Sequence
  Description of Artificial Sequence: Synthetic oligonucleotide
gactgtaatgacctcacctc

SEQ ID NO: 8008 - DNA, 20 bp, Artificial Sequence
  Description of Artificial Sequence: Synthetic oligonucleotide
actgtaatgacctcacctcc

SEQ ID NO: 8009 - DNA, 20 bp, Artificial Sequence
  Description of Artificial Sequence: Synthetic oligonucleotide
ctgtaatgacctcacctcca

SEQ ID NO: 8010 - DNA, 20 bp, Artificial Sequence
  Description of Artificial Sequence: Synthetic oligonucleotide
tgtaatgacctcacctccag

SEQ ID NO: 8011 - DNA, 20 bp, Artificial Sequence
  Description of Artificial Sequence: Synthetic oligonucleotide
gtaatgacctcacctccagt

SEQ ID NO: 8012 - DNA, 20 bp, Artificial Sequence
  Description of Artificial Sequence: Synthetic oligonucleotide
taatgacctcacctccagtt

SEQ ID NO: 8013 - DNA, 20 bp, Artificial Sequence
  Description of Artificial Sequence: Synthetic oligonucleotide
aatgacctcacctccagttc

SEQ ID NO: 8014 - DNA, 20 bp, Artificial Sequence
  Description of Artificial Sequence: Synthetic oligonucleotide
atgacctcacctccagttca

SEQ ID NO: 8015 - DNA, 20 bp, Artificial Sequence
  Description of Artificial Sequence: Synthetic oligonucleotide
tgacctcacctccagttcag

SEQ ID NO: 8016 - DNA, 20 bp, Artificial Sequence
  Description of Artificial Sequence: Synthetic oligonucleotide
gacctcacctccagttcagg

SEQ ID NO: 8017 - DNA, 20 bp, Artificial Sequence
  Description of Artificial Sequence: Synthetic oligonucleotide
acctcacctccagttcaggg

SEQ ID NO: 8018 - DNA, 20 bp, Artificial Sequence
  Description of Artificial Sequence: Synthetic oligonucleotide
cctcacctccagttcagggc

SEQ ID NO: 8019 - DNA, 20 bp, Artificial Sequence
  Description of Artificial Sequence: Synthetic oligonucleotide
ctcacctccagttcagggct

SEQ ID NO: 8020 - DNA, 20 bp, Artificial Sequence
  Description of Artificial Sequence: Synthetic oligonucleotide
tcacctccagttcagggctg

SEQ ID NO: 8021 - DNA, 20 bp, Artificial Sequence
  Description of Artificial Sequence: Synthetic oligonucleotide
cacctccagttcagggctgc

SEQ ID NO: 8022 - DNA, 20 bp, Artificial Sequence
  Description of Artificial Sequence: Synthetic oligonucleotide
acctccagttcagggctgcc

SEQ ID NO: 8023 - DNA, 20 bp, Artificial Sequence
  Description of Artificial Sequence: Synthetic oligonucleotide
cctccagttcagggctgccc

SEQ ID NO: 8024 - DNA, 20 bp, Artificial Sequence
  Description of Artificial Sequence: Synthetic oligonucleotide
ctccagttcagggctgccca

SEQ ID NO: 8025 - DNA, 20 bp, Artificial Sequence
  Description of Artificial Sequence: Synthetic oligonucleotide
tccagttcagggctgcccag

SEQ ID NO: 8026 - DNA, 20 bp, Artificial Sequence
  Description of Artificial Sequence: Synthetic oligonucleotide
ccagttcagggctgcccagg

SEQ ID NO: 8027 - DNA, 20 bp, Artificial Sequence
  Description of Artificial Sequence: Synthetic oligonucleotide
cagttcagggctgcccagga

SEQ ID NO: 8028 - DNA, 20 bp, Artificial Sequence
  Description of Artificial Sequence: Synthetic oligonucleotide
agttcagggctgcccaggaa

SEQ ID NO: 8029 - DNA, 20 bp, Artificial Sequence
  Description of Artificial Sequence: Synthetic oligonucleotide
gttcagggctgcccaggaag

SEQ ID NO: 8030 - DNA, 20 bp, Artificial Sequence
  Description of Artificial Sequence: Synthetic oligonucleotide
ttcagggctgcccaggaagt

SEQ ID NO: 8031 - DNA, 20 bp, Artificial Sequence
  Description of Artificial Sequence: Synthetic oligonucleotide
tcagggctgcccaggaagtc

SEQ ID NO: 8032 - DNA, 20 bp, Artificial Sequence
  Description of Artificial Sequence: Synthetic oligonucleotide
cagggctgcccaggaagtca

SEQ ID NO: 8033 - DNA, 20 bp, Artificial Sequence
  Description of Artificial Sequence: Synthetic oligonucleotide
agggctgcccaggaagtcat

SEQ ID NO: 8034 - DNA, 20 bp, Artificial Sequence
  Description of Artificial Sequence: Synthetic oligonucleotide
gggctgcccaggaagtcatc

SEQ ID NO: 8035 - DNA, 20 bp, Artificial Sequence
  Description of Artificial Sequence: Synthetic oligonucleotide
ggctgcccaggaagtcatca

SEQ ID NO: 8036 - DNA, 20 bp, Artificial Sequence
  Description of Artificial Sequence: Synthetic oligonucleotide
gctgcccaggaagtcatcag

SEQ ID NO: 8037 - DNA, 20 bp, Artificial Sequence
  Description of Artificial Sequence: Synthetic oligonucleotide
ctgcccaggaagtcatcagg

SEQ ID NO: 8038 - DNA, 20 bp, Artificial Sequence
  Description of Artificial Sequence: Synthetic oligonucleotide
tgcccaggaagtcatcagga

SEQ ID NO: 8039 - DNA, 20 bp, Artificial Sequence
  Description of Artificial Sequence: Synthetic oligonucleotide
gcccaggaagtcatcaggag

SEQ ID NO: 8040 - DNA, 20 bp, Artificial Sequence
  Description of Artificial Sequence: Synthetic oligonucleotide
cccaggaagtcatcaggagg

SEQ ID NO: 8041 - DNA, 20 bp, Artificial Sequence
  Description of Artificial Sequence: Synthetic oligonucleotide
ccaggaagtcatcaggagga

SEQ ID NO: 8042 - DNA, 20 bp, Artificial Sequence
  Description of Artificial Sequence: Synthetic oligonucleotide
caggaagtcatcaggaggaa

SEQ ID NO: 8043 - DNA, 20 bp, Artificial Sequence
  Description of Artificial Sequence: Synthetic oligonucleotide
aggaagtcatcaggaggaag

SEQ ID NO: 8044 - DNA, 20 bp, Artificial Sequence
  Description of Artificial Sequence: Synthetic oligonucleotide
ggaagtcatcaggaggaagc

SEQ ID NO: 8045 - DNA, 20 bp, Artificial Sequence
  Description of Artificial Sequence: Synthetic oligonucleotide
gaagtcatcaggaggaagct

SEQ ID NO: 8046 - DNA, 20 bp, Artificial Sequence
  Description of Artificial Sequence: Synthetic oligonucleotide
aagtcatcaggaggaagctt

SEQ ID NO: 8047 - DNA, 20 bp, Artificial Sequence
  Description of Artificial Sequence: Synthetic oligonucleotide
agtcatcaggaggaagctta

SEQ ID NO: 8048 - DNA, 20 bp, Artificial Sequence
  Description of Artificial Sequence: Synthetic oligonucleotide
gtcatcaggaggaagcttat

SEQ ID NO: 8049 - DNA, 20 bp, Artificial Sequence
  Description of Artificial Sequence: Synthetic oligonucleotide
tcatcaggaggaagcttata

SEQ ID NO: 8050 - DNA, 20 bp, Artificial Sequence
  Description of Artificial Sequence: Synthetic oligonucleotide
catcaggaggaagcttatac

SEQ ID NO: 8051 - DNA, 20 bp, Artificial Sequence
  Description of Artificial Sequence: Synthetic oligonucleotide
atcaggaggaagcttataca

SEQ ID NO: 8052 - DNA, 20 bp, Artificial Sequence
  Description of Artificial Sequence: Synthetic oligonucleotide
tcaggaggaagcttatacac

SEQ ID NO: 8053 - DNA, 20 bp, Artificial Sequence
  Description of Artificial Sequence: Synthetic oligonucleotide
caggaggaagcttatacact

SEQ ID NO: 8054 - DNA, 20 bp, Artificial Sequence
  Description of Artificial Sequence: Synthetic oligonucleotide
aggaggaagcttatacactc

SEQ ID NO: 8055 - DNA, 20 bp, Artificial Sequence
  Description of Artificial Sequence: Synthetic oligonucleotide
ggaggaagcttatacactcc

SEQ ID NO: 8056 - DNA, 20 bp, Artificial Sequence
  Description of Artificial Sequence: Synthetic oligonucleotide
gaggaagcttatacactcca

SEQ ID NO: 8057 - DNA, 20 bp, Artificial Sequence
  Description of Artificial Sequence: Synthetic oligonucleotide
aggaagcttatacactccag

SEQ ID NO: 8058 - DNA, 20 bp, Artificial Sequence
  Description of Artificial Sequence: Synthetic oligonucleotide
ggaagcttatacactccaga

SEQ ID NO: 8059 - DNA, 20 bp, Artificial Sequence
  Description of Artificial Sequence: Synthetic oligonucleotide
gaagcttatacactccagag

SEQ ID NO: 8060 - DNA, 20 bp, Artificial Sequence
  Description of Artificial Sequence: Synthetic oligonucleotide
aagcttatacactccagaga

SEQ ID NO: 8061 - DNA, 20 bp, Artificial Sequence
  Description of Artificial Sequence: Synthetic oligonucleotide
agcttatacactccagagat

SEQ ID NO: 8062 - DNA, 20 bp, Artificial Sequence
  Description of Artificial Sequence: Synthetic oligonucleotide
gcttatacactccagagatg

SEQ ID NO: 8063 - DNA, 20 bp, Artificial Sequence
  Description of Artificial Sequence: Synthetic oligonucleotide
cttatacactccagagatgc

SEQ ID NO: 8064 - DNA, 20 bp, Artificial Sequence
  Description of Artificial Sequence: Synthetic oligonucleotide
ttatacactccagagatgcg

SEQ ID NO: 8065 - DNA, 20 bp, Artificial Sequence
  Description of Artificial Sequence: Synthetic oligonucleotide
tatacactccagagatgcgg

SEQ ID NO: 8066 - DNA, 20 bp, Artificial Sequence
  Description of Artificial Sequence: Synthetic oligonucleotide
atacactccagagatgcggt

SEQ ID NO: 8067 - DNA, 20 bp, Artificial Sequence
  Description of Artificial Sequence: Synthetic oligonucleotide
tacactccagagatgcggta

SEQ ID NO: 8068 - DNA, 20 bp, Artificial Sequence
  Description of Artificial Sequence: Synthetic oligonucleotide
acactccagagatgcggtag

SEQ ID NO: 8069 - DNA, 20 bp, Artificial Sequence
  Description of Artificial Sequence: Synthetic oligonucleotide
cactccagagatgcggtagt

SEQ ID NO: 8070 - DNA, 20 bp, Artificial Sequence
  Description of Artificial Sequence: Synthetic oligonucleotide
actccagagatgcggtagtt

SEQ ID NO: 8071 - DNA, 20 bp, Artificial Sequence
  Description of Artificial Sequence: Synthetic oligonucleotide
ctccagagatgcggtagttc

SEQ ID NO: 8072 - DNA, 20 bp, Artificial Sequence
  Description of Artificial Sequence: Synthetic oligonucleotide
tccagagatgcggtagttct

SEQ ID NO: 8073 - DNA, 20 bp, Artificial Sequence
  Description of Artificial Sequence: Synthetic oligonucleotide
ccagagatgcggtagttctt

SEQ ID NO: 8074 - DNA, 20 bp, Artificial Sequence
  Description of Artificial Sequence: Synthetic oligonucleotide
cagagatgcggtagttcttc

SEQ ID NO: 8075 - DNA, 20 bp, Artificial Sequence
  Description of Artificial Sequence: Synthetic oligonucleotide
agagatgcggtagttcttct

SEQ ID NO: 8076 - DNA, 20 bp, Artificial Sequence
  Description of Artificial Sequence: Synthetic oligonucleotide
gagatgcggtagttcttctg

SEQ ID NO: 8077 - DNA, 20 bp, Artificial Sequence
  Description of Artificial Sequence: Synthetic oligonucleotide
agatgcggtagttcttctgg

SEQ ID NO: 8078 - DNA, 20 bp, Artificial Sequence
  Description of Artificial Sequence: Synthetic oligonucleotide
gatgcggtagttcttctggt

SEQ ID NO: 8079 - DNA, 20 bp, Artificial Sequence
  Description of Artificial Sequence: Synthetic oligonucleotide
atgcggtagttcttctggta

SEQ ID NO: 8080 - DNA, 20 bp, Artificial Sequence
  Description of Artificial Sequence: Synthetic oligonucleotide
tgcggtagttcttctggtag

SEQ ID NO: 8081 - DNA, 20 bp, Artificial Sequence
  Description of Artificial Sequence: Synthetic oligonucleotide
gcggtagttcttctggtaga

SEQ ID NO: 8082 - DNA, 20 bp, Artificial Sequence
  Description of Artificial Sequence: Synthetic oligonucleotide
cggtagttcttctggtagag

SEQ ID NO: 8083 - DNA, 20 bp, Artificial Sequence
  Description of Artificial Sequence: Synthetic oligonucleotide
ggtagttcttctggtagagg

SEQ ID NO: 8084 - DNA, 20 bp, Artificial Sequence
  Description of Artificial Sequence: Synthetic oligonucleotide
gtagttcttctggtagaggg

SEQ ID NO: 8085 - DNA, 20 bp, Artificial Sequence
  Description of Artificial Sequence: Synthetic oligonucleotide
tagttcttctggtagaggga

SEQ ID NO: 8086 - DNA, 20 bp, Artificial Sequence
  Description of Artificial Sequence: Synthetic oligonucleotide
agttcttctggtagagggaa

SEQ ID NO: 8087 - DNA, 20 bp, Artificial Sequence
  Description of Artificial Sequence: Synthetic oligonucleotide
gttcttctggtagagggaag

SEQ ID NO: 8088 - DNA, 20 bp, Artificial Sequence
  Description of Artificial Sequence: Synthetic oligonucleotide
ttcttctggtagagggaaga

SEQ ID NO: 8089 - DNA, 20 bp, Artificial Sequence
  Description of Artificial Sequence: Synthetic oligonucleotide
tcttctggtagagggaagag

SEQ ID NO: 8090 - DNA, 20 bp, Artificial Sequence
  Description of Artificial Sequence: Synthetic oligonucleotide
cttctggtagagggaagagc

SEQ ID NO: 8091 - DNA, 20 bp, Artificial Sequence
  Description of Artificial Sequence: Synthetic oligonucleotide
ttctggtagagggaagagca

SEQ ID NO: 8092 - DNA, 20 bp, Artificial Sequence
  Description of Artificial Sequence: Synthetic oligonucleotide
tctggtagagggaagagcag

SEQ ID NO: 8093 - DNA, 20 bp, Artificial Sequence
  Description of Artificial Sequence: Synthetic oligonucleotide
ctggtagagggaagagcagt

SEQ ID NO: 8094 - DNA, 20 bp, Artificial Sequence
  Description of Artificial Sequence: Synthetic oligonucleotide
tggtagagggaagagcagtc

SEQ ID NO: 8095 - DNA, 20 bp, Artificial Sequence
  Description of Artificial Sequence: Synthetic oligonucleotide
ggtagagggaagagcagtcg

SEQ ID NO: 8096 - DNA, 20 bp, Artificial Sequence
  Description of Artificial Sequence: Synthetic oligonucleotide
gtagagggaagagcagtcgt

SEQ ID NO: 8097 - DNA, 20 bp, Artificial Sequence
  Description of Artificial Sequence: Synthetic oligonucleotide
tagagggaagagcagtcgta

SEQ ID NO: 8098 - DNA, 20 bp, Artificial Sequence
  Description of Artificial Sequence: Synthetic oligonucleotide
agagggaagagcagtcgtag

SEQ ID NO: 8099 - DNA, 20 bp, Artificial Sequence
  Description of Artificial Sequence: Synthetic oligonucleotide
gagggaagagcagtcgtaga

SEQ ID NO: 8100 - DNA, 20 bp, Artificial Sequence
  Description of Artificial Sequence: Synthetic oligonucleotide
agggaagagcagtcgtagat

SEQ ID NO: 8101 - DNA, 20 bp, Artificial Sequence
  Description of Artificial Sequence: Synthetic oligonucleotide
gggaagagcagtcgtagatg

SEQ ID NO: 8102 - DNA, 20 bp, Artificial Sequence
  Description of Artificial Sequence: Synthetic oligonucleotide
ggaagagcagtcgtagatgg

SEQ ID NO: 8103 - DNA, 20 bp, Artificial Sequence
  Description of Artificial Sequence: Synthetic oligonucleotide
gaagagcagtcgtagatggc

SEQ ID NO: 8104 - DNA, 20 bp, Artificial Sequence
  Description of Artificial Sequence: Synthetic oligonucleotide
aagagcagtcgtagatggca

SEQ ID NO: 8105 - DNA, 20 bp, Artificial Sequence
  Description of Artificial Sequence: Synthetic oligonucleotide
agagcagtcgtagatggcat

SEQ ID NO: 8106 - DNA, 20 bp, Artificial Sequence
  Description of Artificial Sequence: Synthetic oligonucleotide
gagcagtcgtagatggcatc

SEQ ID NO: 8107 - DNA, 20 bp, Artificial Sequence
  Description of Artificial Sequence: Synthetic oligonucleotide
agcagtcgtagatggcatct

SEQ ID NO: 8108 - DNA, 20 bp, Artificial Sequence
  Description of Artificial Sequence: Synthetic oligonucleotide
gcagtcgtagatggcatcta

SEQ ID NO: 8109 - DNA, 20 bp, Artificial Sequence
  Description of Artificial Sequence: Synthetic oligonucleotide
cagtcgtagatggcatctac

SEQ ID NO: 8110 - DNA, 20 bp, Artificial Sequence
  Description of Artificial Sequence: Synthetic oligonucleotide
agtcgtagatggcatctaca

SEQ ID NO: 8111 - DNA, 20 bp, Artificial Sequence
  Description of Artificial Sequence: Synthetic oligonucleotide
gtcgtagatggcatctacaa

SEQ ID NO: 8112 - DNA, 20 bp, Artificial Sequence
  Description of Artificial Sequence: Synthetic oligonucleotide
tcgtagatggcatctacaag

SEQ ID NO: 8113 - DNA, 20 bp, Artificial Sequence
  Description of Artificial Sequence: Synthetic oligonucleotide
cgtagatggcatctacaaga

SEQ ID NO: 8114 - DNA, 20 bp, Artificial Sequence
  Description of Artificial Sequence: Synthetic oligonucleotide
gtagatggcatctacaagag

SEQ ID NO: 8115 - DNA, 20 bp, Artificial Sequence
  Description of Artificial Sequence: Synthetic oligonucleotide
tagatggcatctacaagaga

SEQ ID NO: 8116 - DNA, 20 bp, Artificial Sequence
  Description of Artificial Sequence: Synthetic oligonucleotide
agatggcatctacaagagaa

SEQ ID NO: 8117 - DNA, 20 bp, Artificial Sequence
  Description of Artificial Sequence: Synthetic oligonucleotide
gatggcatctacaagagaac

SEQ ID NO: 8118 - DNA, 20 bp, Artificial Sequence
  Description of Artificial Sequence: Synthetic oligonucleotide
atggcatctacaagagaaca

SEQ ID NO: 8119 - DNA, 20 bp, Artificial Sequence
  Description of Artificial Sequence: Synthetic oligonucleotide
tggcatctacaagagaacaa

SEQ ID NO: 8120 - DNA, 20 bp, Artificial Sequence
  Description of Artificial Sequence: Synthetic oligonucleotide
ggcatctacaagagaacaaa

SEQ ID NO: 8121 - DNA, 20 bp, Artificial Sequence
  Description of Artificial Sequence: Synthetic oligonucleotide
gcatctacaagagaacaaac

SEQ ID NO: 8122 - DNA, 20 bp, Artificial Sequence
  Description of Artificial Sequence: Synthetic oligonucleotide
catctacaagagaacaaacc

SEQ ID NO: 8123 - DNA, 20 bp, Artificial Sequence
  Description of Artificial Sequence: Synthetic oligonucleotide
atctacaagagaacaaacca

SEQ ID NO: 8124 - DNA, 20 bp, Artificial Sequence
  Description of Artificial Sequence: Synthetic oligonucleotide
tctacaagagaacaaaccac

SEQ ID NO: 8125 - DNA, 20 bp, Artificial Sequence
  Description of Artificial Sequence: Synthetic oligonucleotide
ctacaagagaacaaaccaca

SEQ ID NO: 8126 - DNA, 20 bp, Artificial Sequence
  Description of Artificial Sequence: Synthetic oligonucleotide
tacaagagaacaaaccacag

SEQ ID NO: 8127 - DNA, 20 bp, Artificial Sequence
  Description of Artificial Sequence: Synthetic oligonucleotide
acaagagaacaaaccacagg

SEQ ID NO: 8128 - DNA, 20 bp, Artificial Sequence
  Description of Artificial Sequence: Synthetic oligonucleotide
caagagaacaaaccacaggg

SEQ ID NO: 8129 - DNA, 20 bp, Artificial Sequence
  Description of Artificial Sequence: Synthetic oligonucleotide
aagagaacaaaccacagggt

SEQ ID NO: 8130 - DNA, 20 bp, Artificial Sequence
  Description of Artificial Sequence: Synthetic oligonucleotide
agagaacaaaccacagggtg

SEQ ID NO: 8131 - DNA, 20 bp, Artificial Sequence
  Description of Artificial Sequence: Synthetic oligonucleotide
gagaacaaaccacagggtga

SEQ ID NO: 8132 - DNA, 20 bp, Artificial Sequence
  Description of Artificial Sequence: Synthetic oligonucleotide
agaacaaaccacagggtgag

SEQ ID NO: 8133 - DNA, 20 bp, Artificial Sequence
  Description of Artificial Sequence: Synthetic oligonucleotide
gaacaaaccacagggtgagc

SEQ ID NO: 8134 - DNA, 20 bp, Artificial Sequence
  Description of Artificial Sequence: Synthetic oligonucleotide
aacaaaccacagggtgagca

SEQ ID NO: 8135 - DNA, 20 bp, Artificial Sequence
  Description of Artificial Sequence: Synthetic oligonucleotide
acaaaccacagggtgagcat

SEQ ID NO: 8136 - DNA, 20 bp, Artificial Sequence
  Description of Artificial Sequence: Synthetic oligonucleotide
caaaccacagggtgagcatt

SEQ ID NO: 8137 - DNA, 20 bp, Artificial Sequence
  Description of Artificial Sequence: Synthetic oligonucleotide
aaaccacagggtgagcattt

SEQ ID NO: 8138 - DNA, 20 bp, Artificial Sequence
  Description of Artificial Sequence: Synthetic oligonucleotide
aaccacagggtgagcattta

SEQ ID NO: 8139 - DNA, 20 bp, Artificial Sequence
  Description of Artificial Sequence: Synthetic oligonucleotide
accacagggtgagcatttag

SEQ ID NO: 8140 - DNA, 20 bp, Artificial Sequence
  Description of Artificial Sequence: Synthetic oligonucleotide
ccacagggtgagcatttaga

SEQ ID NO: 8141 - DNA, 20 bp, Artificial Sequence
  Description of Artificial Sequence: Synthetic oligonucleotide
cacagggtgagcatttagac

SEQ ID NO: 8142 - DNA, 20 bp, Artificial Sequence
  Description of Artificial Sequence: Synthetic oligonucleotide
acagggtgagcatttagacc

SEQ ID NO: 8143 - DNA, 20 bp, Artificial Sequence
  Description of Artificial Sequence: Synthetic oligonucleotide
cagggtgagcatttagaccc

SEQ ID NO: 8144 - DNA, 20 bp, Artificial Sequence
  Description of Artificial Sequence: Synthetic oligonucleotide
agggtgagcatttagaccca

SEQ ID NO: 8145 - DNA, 20 bp, Artificial Sequence
  Description of Artificial Sequence: Synthetic oligonucleotide
gggtgagcatttagacccag

SEQ ID NO: 8146 - DNA, 20 bp, Artificial Sequence
  Description of Artificial Sequence: Synthetic oligonucleotide
ggtgagcatttagacccagt

SEQ ID NO: 8147 - DNA, 20 bp, Artificial Sequence
  Description of Artificial Sequence: Synthetic oligonucleotide
gtgagcatttagacccagtg

SEQ ID NO: 8148 - DNA, 20 bp, Artificial Sequence
  Description of Artificial Sequence: Synthetic oligonucleotide
tgagcatttagacccagtgg

SEQ ID NO: 8149 - DNA, 20 bp, Artificial Sequence
  Description of Artificial Sequence: Synthetic oligonucleotide
gagcatttagacccagtggc

SEQ ID NO: 8150 - DNA, 20 bp, Artificial Sequence
  Description of Artificial Sequence: Synthetic oligonucleotide
agcatttagacccagtggct

SEQ ID NO: 8151 - DNA, 20 bp, Artificial Sequence
  Description of Artificial Sequence: Synthetic oligonucleotide
gcatttagacccagtggctc

SEQ ID NO: 8152 - DNA, 20 bp, Artificial Sequence
  Description of Artificial Sequence: Synthetic oligonucleotide
catttagacccagtggctcc

SEQ ID NO: 8153 - DNA, 20 bp, Artificial Sequence
  Description of Artificial Sequence: Synthetic oligonucleotide
atttagacccagtggctcca

SEQ ID NO: 8154 - DNA, 20 bp, Artificial Sequence
  Description of Artificial Sequence: Synthetic oligonucleotide
tttagacccagtggctccat

SEQ ID NO: 8155 - DNA, 20 bp, Artificial Sequence
  Description of Artificial Sequence: Synthetic oligonucleotide
ttagacccagtggctccatc

SEQ ID NO: 8156 - DNA, 20 bp, Artificial Sequence
  Description of Artificial Sequence: Synthetic oligonucleotide
tagacccagtggctccatct

SEQ ID NO: 8157 - DNA, 20 bp, Artificial Sequence
  Description of Artificial Sequence: Synthetic oligonucleotide
agacccagtggctccatctg

SEQ ID NO: 8158 - DNA, 20 bp, Artificial Sequence
  Description of Artificial Sequence: Synthetic oligonucleotide
gacccagtggctccatctga

SEQ ID NO: 8159 - DNA, 20 bp, Artificial Sequence
  Description of Artificial Sequence: Synthetic oligonucleotide
acccagtggctccatctgag

SEQ ID NO: 8160 - DNA, 20 bp, Artificial Sequence
  Description of Artificial Sequence: Synthetic oligonucleotide
cccagtggctccatctgagt

SEQ ID NO: 8161 - DNA, 20 bp, Artificial Sequence
  Description of Artificial Sequence: Synthetic oligonucleotide
ccagtggctccatctgagtt

SEQ ID NO: 8162 - DNA, 20 bp, Artificial Sequence
  Description of Artificial Sequence: Synthetic oligonucleotide
cagtggctccatctgagttg

SEQ ID NO: 8163 - DNA, 20 bp, Artificial Sequence
  Description of Artificial Sequence: Synthetic oligonucleotide
agtggctccatctgagttga

SEQ ID NO: 8164 - DNA, 20 bp, Artificial Sequence
  Description of Artificial Sequence: Synthetic oligonucleotide
gtggctccatctgagttgag

SEQ ID NO: 8165 - DNA, 20 bp, Artificial Sequence
  Description of Artificial Sequence: Synthetic oligonucleotide
tggctccatctgagttgagt

SEQ ID NO: 8166 - DNA, 20 bp, Artificial Sequence
  Description of Artificial Sequence: Synthetic oligonucleotide
ggctccatctgagttgagtg

SEQ ID NO: 8167 - DNA, 20 bp, Artificial Sequence
  Description of Artificial Sequence: Synthetic oligonucleotide
gctccatctgagttgagtgt

SEQ ID NO: 8168 - DNA, 20 bp, Artificial Sequence
  Description of Artificial Sequence: Synthetic oligonucleotide
ctccatctgagttgagtgtt

SEQ ID NO: 8169 - DNA, 20 bp, Artificial Sequence
  Description of Artificial Sequence: Synthetic oligonucleotide
tccatctgagttgagtgttt

SEQ ID NO: 8170 - DNA, 20 bp, Artificial Sequence
  Description of Artificial Sequence: Synthetic oligonucleotide
ccatctgagttgagtgttta

SEQ ID NO: 8171 - DNA, 20 bp, Artificial Sequence
  Description of Artificial Sequence: Synthetic oligonucleotide
catctgagttgagtgtttag

SEQ ID NO: 8172 - DNA, 20 bp, Artificial Sequence
  Description of Artificial Sequence: Synthetic oligonucleotide
atctgagttgagtgtttaga

SEQ ID NO: 8173 - DNA, 20 bp, Artificial Sequence
  Description of Artificial Sequence: Synthetic oligonucleotide
tctgagttgagtgtttagag

SEQ ID NO: 8174 - DNA, 20 bp, Artificial Sequence
  Description of Artificial Sequence: Synthetic oligonucleotide
ctgagttgagtgtttagaga

SEQ ID NO: 8175 - DNA, 20 bp, Artificial Sequence
  Description of Artificial Sequence: Synthetic oligonucleotide
tgagttgagtgtttagagac

SEQ ID NO: 8176 - DNA, 20 bp, Artificial Sequence
  Description of Artificial Sequence: Synthetic oligonucleotide
gagttgagtgtttagagact

SEQ ID NO: 8177 - DNA, 20 bp, Artificial Sequence
  Description of Artificial Sequence: Synthetic oligonucleotide
agttgagtgtttagagactg

SEQ ID NO: 8178 - DNA, 20 bp, Artificial Sequence
  Description of Artificial Sequence: Synthetic oligonucleotide
gttgagtgtttagagactga

SEQ ID NO: 8179 - DNA, 20 bp, Artificial Sequence
  Description of Artificial Sequence: Synthetic oligonucleotide
ttgagtgtttagagactgag

SEQ ID NO: 8180 - DNA, 20 bp, Artificial Sequence
  Description of Artificial Sequence: Synthetic oligonucleotide
tgagtgtttagagactgagc

SEQ ID NO: 8181 - DNA, 20 bp, Artificial Sequence
  Description of Artificial Sequence: Synthetic oligonucleotide
gagtgtttagagactgagcc

SEQ ID NO: 8182 - DNA, 20 bp, Artificial Sequence
  Description of Artificial Sequence: Synthetic oligonucleotide
agtgtttagagactgagcct

SEQ ID NO: 8183 - DNA, 20 bp, Artificial Sequence
  Description of Artificial Sequence: Synthetic oligonucleotide
gtgtttagagactgagcctt

SEQ ID NO: 8184 - DNA, 20 bp, Artificial Sequence
  Description of Artificial Sequence: Synthetic oligonucleotide
tgtttagagactgagccttt

SEQ ID NO: 8185 - DNA, 20 bp, Artificial Sequence
  Description of Artificial Sequence: Synthetic oligonucleotide
gtttagagactgagccttta

SEQ ID NO: 8186 - DNA, 20 bp, Artificial Sequence
  Description of Artificial Sequence: Synthetic oligonucleotide
tttagagactgagcctttat

SEQ ID NO: 8187 - DNA, 20 bp, Artificial Sequence
  Description of Artificial Sequence: Synthetic oligonucleotide
ttagagactgagcctttatt

SEQ ID NO: 8188 - DNA, 20 bp, Artificial Sequence
  Description of Artificial Sequence: Synthetic oligonucleotide
tagagactgagcctttattt

SEQ ID NO: 8189 - DNA, 20 bp, Artificial Sequence
  Description of Artificial Sequence: Synthetic oligonucleotide
agagactgagcctttatttc

SEQ ID NO: 8190 - DNA, 20 bp, Artificial Sequence
  Description of Artificial Sequence: Synthetic oligonucleotide
gagactgagcctttatttct

SEQ ID NO: 8191 - DNA, 20 bp, Artificial Sequence
  Description of Artificial Sequence: Synthetic oligonucleotide
agactgagcctttatttcta

SEQ ID NO: 8192 - DNA, 20 bp, Artificial Sequence
  Description of Artificial Sequence: Synthetic oligonucleotide
gactgagcctttatttctac

SEQ ID NO: 8193 - DNA, 20 bp, Artificial Sequence
  Description of Artificial Sequence: Synthetic oligonucleotide
actgagcctttatttctacc

SEQ ID NO: 8194 - DNA, 20 bp, Artificial Sequence
  Description of Artificial Sequence: Synthetic oligonucleotide
ctgagcctttatttctaccc

SEQ ID NO: 8195 - DNA, 20 bp, Artificial Sequence
  Description of Artificial Sequence: Synthetic oligonucleotide
tgagcctttatttctaccct

SEQ ID NO: 8196 - DNA, 20 bp, Artificial Sequence
  Description of Artificial Sequence: Synthetic oligonucleotide
gagcctttatttctaccctg

SEQ ID NO: 8197 - DNA, 20 bp, Artificial Sequence
  Description of Artificial Sequence: Synthetic oligonucleotide
agcctttatttctaccctgg

SEQ ID NO: 8198 - DNA, 20 bp, Artificial Sequence
  Description of Artificial Sequence: Synthetic oligonucleotide
gcctttatttctaccctggg

SEQ ID NO: 8199 - DNA, 20 bp, Artificial Sequence
  Description of Artificial Sequence: Synthetic oligonucleotide
cctttatttctaccctggga

SEQ ID NO: 8200 - DNA, 20 bp, Artificial Sequence
  Description of Artificial Sequence: Synthetic oligonucleotide
ctttatttctaccctgggat

SEQ ID NO: 8201 - DNA, 20 bp, Artificial Sequence
  Description of Artificial Sequence: Synthetic oligonucleotide
tttatttctaccctgggatt

SEQ ID NO: 8202 - DNA, 20 bp, Artificial Sequence
  Description of Artificial Sequence: Synthetic oligonucleotide
ttatttctaccctgggattc

SEQ ID NO: 8203 - DNA, 20 bp, Artificial Sequence
  Description of Artificial Sequence: Synthetic oligonucleotide
tatttctaccctgggattct

SEQ ID NO: 8204 - DNA, 20 bp, Artificial Sequence
  Description of Artificial Sequence: Synthetic oligonucleotide
atttctaccctgggattctc

SEQ ID NO: 8205 - DNA, 20 bp, Artificial Sequence
  Description of Artificial Sequence: Synthetic oligonucleotide
tttctaccctgggattctca

SEQ ID NO: 8206 - DNA, 20 bp, Artificial Sequence
  Description of Artificial Sequence: Synthetic oligonucleotide
ttctaccctgggattctcag

SEQ ID NO: 8207 - DNA, 20 bp, Artificial Sequence
  Description of Artificial Sequence: Synthetic oligonucleotide
tctaccctgggattctcagt

SEQ ID NO: 8208 - DNA, 20 bp, Artificial Sequence
  Description of Artificial Sequence: Synthetic oligonucleotide
ctaccctgggattctcagtg

SEQ ID NO: 8209 - DNA, 20 bp, Artificial Sequence
  Description of Artificial Sequence: Synthetic oligonucleotide
taccctgggattctcagtgg

SEQ ID NO: 8210 - DNA, 20 bp, Artificial Sequence
  Description of Artificial Sequence: Synthetic oligonucleotide
accctgggattctcagtggt

SEQ ID NO: 8211 - DNA, 20 bp, Artificial Sequence
  Description of Artificial Sequence: Synthetic oligonucleotide
ccctgggattctcagtggtg

SEQ ID NO: 8212 - DNA, 20 bp, Artificial Sequence
  Description of Artificial Sequence: Synthetic oligonucleotide
cctgggattctcagtggtgt

SEQ ID NO: 8213 - DNA, 20 bp, Artificial Sequence
  Description of Artificial Sequence: Synthetic oligonucleotide
ctgggattctcagtggtgtt

SEQ ID NO: 8214 - DNA, 20 bp, Artificial Sequence
  Description of Artificial Sequence: Synthetic oligonucleotide
tgggattctcagtggtgtta

SEQ ID NO: 8215 - DNA, 20 bp, Artificial Sequence
  Description of Artificial Sequence: Synthetic oligonucleotide
gggattctcagtggtgttaa

SEQ ID NO: 8216 - DNA, 20 bp, Artificial Sequence
  Description of Artificial Sequence: Synthetic oligonucleotide
ggattctcagtggtgttaat

SEQ ID NO: 8217 - DNA, 20 bp, Artificial Sequence
  Description of Artificial Sequence: Synthetic oligonucleotide
gattctcagtggtgttaatt

SEQ ID NO: 8218 - DNA, 20 bp, Artificial Sequence
  Description of Artificial Sequence: Synthetic oligonucleotide
attctcagtggtgttaatta

SEQ ID NO: 8219 - DNA, 20 bp, Artificial Sequence
  Description of Artificial Sequence: Synthetic oligonucleotide
ttctcagtggtgttaattac

SEQ ID NO: 8220 - DNA, 20 bp, Artificial Sequence
  Description of Artificial Sequence: Synthetic oligonucleotide
tctcagtggtgttaattacc

SEQ ID NO: 8221 - DNA, 20 bp, Artificial Sequence
  Description of Artificial Sequence: Synthetic oligonucleotide
ctcagtggtgttaattaccc

SEQ ID NO: 8222 - DNA, 20 bp, Artificial Sequence
  Description of Artificial Sequence: Synthetic oligonucleotide
tcagtggtgttaattaccca

SEQ ID NO: 8223 - DNA, 20 bp, Artificial Sequence
  Description of Artificial Sequence: Synthetic oligonucleotide
cagtggtgttaattacccat

SEQ ID NO: 8224 - DNA, 20 bp, Artificial Sequence
  Description of Artificial Sequence: Synthetic oligonucleotide
agtggtgttaattacccatc

SEQ ID NO: 8225 - DNA, 20 bp, Artificial Sequence
  Description of Artificial Sequence: Synthetic oligonucleotide
gtggtgttaattacccatca

SEQ ID NO: 8226 - DNA, 20 bp, Artificial Sequence
  Description of Artificial Sequence: Synthetic oligonucleotide
tggtgttaattacccatcag

SEQ ID NO: 8227 - DNA, 20 bp, Artificial Sequence
  Description of Artificial Sequence: Synthetic oligonucleotide
ggtgttaattacccatcagt

SEQ ID NO: 8228 - DNA, 20 bp, Artificial Sequence
  Description of Artificial Sequence: Synthetic oligonucleotide
gtgttaattacccatcagtg

SEQ ID NO: 8229 - DNA, 20 bp, Artificial Sequence
  Description of Artificial Sequence: Synthetic oligonucleotide
tgttaattacccatcagtgt

SEQ ID NO: 8230 - DNA, 20 bp, Artificial Sequence
  Description of Artificial Sequence: Synthetic oligonucleotide
gttaattacccatcagtgtc

SEQ ID NO: 8231 - DNA, 20 bp, Artificial Sequence
  Description of Artificial Sequence: Synthetic oligonucleotide
ttaattacccatcagtgtct

SEQ ID NO: 8232 - DNA, 20 bp, Artificial Sequence
  Description of Artificial Sequence: Synthetic oligonucleotide
taattacccatcagtgtctg

SEQ ID NO: 8233 - DNA, 20 bp, Artificial Sequence
  Description of Artificial Sequence: Synthetic oligonucleotide
aattacccatcagtgtctgc

SEQ ID NO: 8234 - DNA, 20 bp, Artificial Sequence
  Description of Artificial Sequence: Synthetic oligonucleotide
attacccatcagtgtctgca

SEQ ID NO: 8235 - DNA, 20 bp, Artificial Sequence
  Description of Artificial Sequence: Synthetic oligonucleotide
ttacccatcagtgtctgcat

SEQ ID NO: 8236 - DNA, 20 bp, Artificial Sequence
  Description of Artificial Sequence: Synthetic oligonucleotide
tacccatcagtgtctgcatt

SEQ ID NO: 8237 - DNA, 20 bp, Artificial Sequence
  Description of Artificial Sequence: Synthetic oligonucleotide
acccatcagtgtctgcattt

SEQ ID NO: 8238 - DNA, 20 bp, Artificial Sequence
  Description of Artificial Sequence: Synthetic oligonucleotide
cccatcagtgtctgcatttg

SEQ ID NO: 8239 - DNA, 20 bp, Artificial Sequence
  Description of Artificial Sequence: Synthetic oligonucleotide
ccatcagtgtctgcatttgg

SEQ ID NO: 8240 - DNA, 20 bp, Artificial Sequence
  Description of Artificial Sequence: Synthetic oligonucleotide
catcagtgtctgcatttggg

SEQ ID NO: 8241 - DNA, 20 bp, Artificial Sequence
  Description of Artificial Sequence: Synthetic oligonucleotide
atcagtgtctgcatttggga

SEQ ID NO: 8242 - DNA, 20 bp, Artificial Sequence
  Description of Artificial Sequence: Synthetic oligonucleotide
tcagtgtctgcatttgggag

SEQ ID NO: 8243 - DNA, 20 bp, Artificial Sequence
  Description of Artificial Sequence: Synthetic oligonucleotide
cagtgtctgcatttgggaga

SEQ ID NO: 8244 - DNA, 20 bp, Artificial Sequence
  Description of Artificial Sequence: Synthetic oligonucleotide
agtgtctgcatttgggagag

SEQ ID NO: 8245 - DNA, 20 bp, Artificial Sequence
  Description of Artificial Sequence: Synthetic oligonucleotide
gtgtctgcatttgggagagg

SEQ ID NO: 8246 - DNA, 20 bp, Artificial Sequence
  Description of Artificial Sequence: Synthetic oligonucleotide
tgtctgcatttgggagaggt

SEQ ID NO: 8247 - DNA, 20 bp, Artificial Sequence
  Description of Artificial Sequence: Synthetic oligonucleotide
gtctgcatttgggagaggtg

SEQ ID NO: 8248 - DNA, 20 bp, Artificial Sequence
  Description of Artificial Sequence: Synthetic oligonucleotide
tctgcatttgggagaggtgg

SEQ ID NO: 8249 - DNA, 20 bp, Artificial Sequence
  Description of Artificial Sequence: Synthetic oligonucleotide
ctgcatttgggagaggtgga

SEQ ID NO: 8250 - DNA, 20 bp, Artificial Sequence
  Description of Artificial Sequence: Synthetic oligonucleotide
tgcatttgggagaggtggat

SEQ ID NO: 8251 - DNA, 20 bp, Artificial Sequence
  Description of Artificial Sequence: Synthetic oligonucleotide
gcatttgggagaggtggata

SEQ ID NO: 8252 - DNA, 20 bp, Artificial Sequence
  Description of Artificial Sequence: Synthetic oligonucleotide
catttgggagaggtggatat

SEQ ID NO: 8253 - DNA, 20 bp, Artificial Sequence
  Description of Artificial Sequence: Synthetic oligonucleotide
atttgggagaggtggatatg

SEQ ID NO: 8254 - DNA, 20 bp, Artificial Sequence
  Description of Artificial Sequence: Synthetic oligonucleotide
tttgggagaggtggatatgg

SEQ ID NO: 8255 - DNA, 20 bp, Artificial Sequence
  Description of Artificial Sequence: Synthetic oligonucleotide
ttgggagaggtggatatggg

SEQ ID NO: 8256 - DNA, 20 bp, Artificial Sequence
  Description of Artificial Sequence: Synthetic oligonucleotide
tgggagaggtggatatgggg

SEQ ID NO: 8257 - DNA, 20 bp, Artificial Sequence
  Description of Artificial Sequence: Synthetic oligonucleotide
gggagaggtggatatgggga

SEQ ID NO: 8258 - DNA, 20 bp, Artificial Sequence
  Description of Artificial Sequence: Synthetic oligonucleotide
ggagaggtggatatggggag

SEQ ID NO: 8259 - DNA, 20 bp, Artificial Sequence
  Description of Artificial Sequence: Synthetic oligonucleotide
gagaggtggatatggggaga

SEQ ID NO: 8260 - DNA, 20 bp, Artificial Sequence
  Description of Artificial Sequence: Synthetic oligonucleotide
agaggtggatatggggagat

SEQ ID NO: 8261 - DNA, 20 bp, Artificial Sequence
  Description of Artificial Sequence: Synthetic oligonucleotide
gaggtggatatggggagatc

SEQ ID NO: 8262 - DNA, 20 bp, Artificial Sequence
  Description of Artificial Sequence: Synthetic oligonucleotide
aggtggatatggggagatcc

SEQ ID NO: 8263 - DNA, 20 bp, Artificial Sequence
  Description of Artificial Sequence: Synthetic oligonucleotide
ggtggatatggggagatcca

SEQ ID NO: 8264 - DNA, 20 bp, Artificial Sequence
  Description of Artificial Sequence: Synthetic oligonucleotide
gtggatatggggagatccag

SEQ ID NO: 8265 - DNA, 20 bp, Artificial Sequence
  Description of Artificial Sequence: Synthetic oligonucleotide
tggatatggggagatccaga

SEQ ID NO: 8266 - DNA, 20 bp, Artificial Sequence
  Description of Artificial Sequence: Synthetic oligonucleotide
ggatatggggagatccagag

SEQ ID NO: 8267 - DNA, 20 bp, Artificial Sequence
  Description of Artificial Sequence: Synthetic oligonucleotide
gatatggggagatccagagg

SEQ ID NO: 8268 - DNA, 20 bp, Artificial Sequence
  Description of Artificial Sequence: Synthetic oligonucleotide
atatggggagatccagaggg

SEQ ID NO: 8269 - DNA, 20 bp, Artificial Sequence
  Description of Artificial Sequence: Synthetic oligonucleotide
tatggggagatccagagggg

SEQ ID NO: 8270 - DNA, 20 bp, Artificial Sequence
  Description of Artificial Sequence: Synthetic oligonucleotide
atggggagatccagaggggg

SEQ ID NO: 8271 - DNA, 20 bp, Artificial Sequence
  Description of Artificial Sequence: Synthetic oligonucleotide
tggggagatccagagggggt

SEQ ID NO: 8272 - DNA, 20 bp, Artificial Sequence
  Description of Artificial Sequence: Synthetic oligonucleotide
ggggagatccagagggggtg

SEQ ID NO: 8273 - DNA, 20 bp, Artificial Sequence
  Description of Artificial Sequence: Synthetic oligonucleotide
gggagatccagagggggtgt

SEQ ID NO: 8274 - DNA, 20 bp, Artificial Sequence
  Description of Artificial Sequence: Synthetic oligonucleotide
ggagatccagagggggtgta

SEQ ID NO: 8275 - DNA, 20 bp, Artificial Sequence
  Description of Artificial Sequence: Synthetic oligonucleotide
gagatccagagggggtgtat

SEQ ID NO: 8276 - DNA, 20 bp, Artificial Sequence
  Description of Artificial Sequence: Synthetic oligonucleotide
agatccagagggggtgtatt

SEQ ID NO: 8277 - DNA, 20 bp, Artificial Sequence
  Description of Artificial Sequence: Synthetic oligonucleotide
gatccagagggggtgtattt

SEQ ID NO: 8278 - DNA, 20 bp, Artificial Sequence
  Description of Artificial Sequence: Synthetic oligonucleotide
atccagagggggtgtatttt

SEQ ID NO: 8279 - DNA, 20 bp, Artificial Sequence
  Description of Artificial Sequence: Synthetic oligonucleotide
tccagagggggtgtattttg

SEQ ID NO: 8280 - DNA, 20 bp, Artificial Sequence
  Description of Artificial Sequence: Synthetic oligonucleotide
ccagagggggtgtattttgg

SEQ ID NO: 8281 - DNA, 20 bp, Artificial Sequence
  Description of Artificial Sequence: Synthetic oligonucleotide
cagagggggtgtattttggc

SEQ ID NO: 8282 - DNA, 20 bp, Artificial Sequence
  Description of Artificial Sequence: Synthetic oligonucleotide
agagggggtgtattttggct

SEQ ID NO: 8283 - DNA, 20 bp, Artificial Sequence
  Description of Artificial Sequence: Synthetic oligonucleotide
gagggggtgtattttggctt

SEQ ID NO: 8284 - DNA, 20 bp, Artificial Sequence
  Description of Artificial Sequence: Synthetic oligonucleotide
agggggtgtattttggcttt

SEQ ID NO: 8285 - DNA, 20 bp, Artificial Sequence
  Description of Artificial Sequence: Synthetic oligonucleotide
gggggtgtattttggcttta

SEQ ID NO: 8286 - DNA, 20 bp, Artificial Sequence
  Description of Artificial Sequence: Synthetic oligonucleotide
ggggtgtattttggctttac

SEQ ID NO: 8287 - DNA, 20 bp, Artificial Sequence
  Description of Artificial Sequence: Synthetic oligonucleotide
gggtgtattttggctttact

SEQ ID NO: 8288 - DNA, 20 bp, Artificial Sequence
  Description of Artificial Sequence: Synthetic oligonucleotide
ggtgtattttggctttacta

SEQ ID NO: 8289 - DNA, 20 bp, Artificial Sequence
  Description of Artificial Sequence: Synthetic oligonucleotide
gtgtattttggctttactag

SEQ ID NO: 8290 - DNA, 20 bp, Artificial Sequence
  Description of Artificial Sequence: Synthetic oligonucleotide
tgtattttggctttactagc

SEQ ID NO: 8291 - DNA, 20 bp, Artificial Sequence
  Description of Artificial Sequence: Synthetic oligonucleotide
gtattttggctttactagcg

SEQ ID NO: 8292 - DNA, 20 bp, Artificial Sequence
  Description of Artificial Sequence: Synthetic oligonucleotide
tattttggctttactagcgg

SEQ ID NO: 8293 - DNA, 20 bp, Artificial Sequence
  Description of Artificial Sequence: Synthetic oligonucleotide
attttggctttactagcggt

SEQ ID NO: 8294 - DNA, 20 bp, Artificial Sequence
  Description of Artificial Sequence: Synthetic oligonucleotide
ttttggctttactagcggtg

SEQ ID NO: 8295 - DNA, 20 bp, Artificial Sequence
  Description of Artificial Sequence: Synthetic oligonucleotide
tttggctttactagcggtgg

SEQ ID NO: 8296 - DNA, 20 bp, Artificial Sequence
  Description of Artificial Sequence: Synthetic oligonucleotide
ttggctttactagcggtgga

SEQ ID NO: 8297 - DNA, 20 bp, Artificial Sequence
  Description of Artificial Sequence: Synthetic oligonucleotide
tggctttactagcggtggag

SEQ ID NO: 8298 - DNA, 20 bp, Artificial Sequence
  Description of Artificial Sequence: Synthetic oligonucleotide
ggctttactagcggtggagc

SEQ ID NO: 8299 - DNA, 20 bp, Artificial Sequence
  Description of Artificial Sequence: Synthetic oligonucleotide
gctttactagcggtggagca

SEQ ID NO: 8300 - DNA, 20 bp, Artificial Sequence
  Description of Artificial Sequence: Synthetic oligonucleotide
ctttactagcggtggagcag

SEQ ID NO: 8301 - DNA, 20 bp, Artificial Sequence
  Description of Artificial Sequence: Synthetic oligonucleotide
tttactagcggtggagcaga

SEQ ID NO: 8302 - DNA, 20 bp, Artificial Sequence
  Description of Artificial Sequence: Synthetic oligonucleotide
ttactagcggtggagcagag

SEQ ID NO: 8303 - DNA, 20 bp, Artificial Sequence
  Description of Artificial Sequence: Synthetic oligonucleotide
tactagcggtggagcagagg

SEQ ID NO: 8304 - DNA, 20 bp, Artificial Sequence
  Description of Artificial Sequence: Synthetic oligonucleotide
actagcggtggagcagaggg

SEQ ID NO: 8305 - DNA, 20 bp, Artificial Sequence
  Description of Artificial Sequence: Synthetic oligonucleotide
ctagcggtggagcagagggg

SEQ ID NO: 8306 - DNA, 20 bp, Artificial Sequence
  Description of Artificial Sequence: Synthetic oligonucleotide
tagcggtggagcagaggggt

SEQ ID NO: 8307 - DNA, 20 bp, Artificial Sequence
  Description of Artificial Sequence: Synthetic oligonucleotide
agcggtggagcagaggggta

SEQ ID NO: 8308 - DNA, 20 bp, Artificial Sequence
  Description of Artificial Sequence: Synthetic oligonucleotide
gcggtggagcagaggggtag

SEQ ID NO: 8309 - DNA, 20 bp, Artificial Sequence
  Description of Artificial Sequence: Synthetic oligonucleotide
cggtggagcagaggggtagg

SEQ ID NO: 8310 - DNA, 20 bp, Artificial Sequence
  Description of Artificial Sequence: Synthetic oligonucleotide
ggtggagcagaggggtaggg

SEQ ID NO: 8311 - DNA, 20 bp, Artificial Sequence
  Description of Artificial Sequence: Synthetic oligonucleotide
gtggagcagaggggtaggga

SEQ ID NO: 8312 - DNA, 20 bp, Artificial Sequence
  Description of Artificial Sequence: Synthetic oligonucleotide
tggagcagaggggtagggaa

SEQ ID NO: 8313 - DNA, 20 bp, Artificial Sequence
  Description of Artificial Sequence: Synthetic oligonucleotide
ggagcagaggggtagggaag

SEQ ID NO: 8314 - DNA, 20 bp, Artificial Sequence
  Description of Artificial Sequence: Synthetic oligonucleotide
gagcagaggggtagggaagc

SEQ ID NO: 8315 - DNA, 20 bp, Artificial Sequence
  Description of Artificial Sequence: Synthetic oligonucleotide
agcagaggggtagggaagcc

SEQ ID NO: 8316 - DNA, 20 bp, Artificial Sequence
  Description of Artificial Sequence: Synthetic oligonucleotide
gcagaggggtagggaagccc

SEQ ID NO: 8317 - DNA, 20 bp, Artificial Sequence
  Description of Artificial Sequence: Synthetic oligonucleotide
cagaggggtagggaagccct

SEQ ID NO: 8318 - DNA, 20 bp, Artificial Sequence
  Description of Artificial Sequence: Synthetic oligonucleotide
agaggggtagggaagccctt

SEQ ID NO: 8319 - DNA, 20 bp, Artificial Sequence
  Description of Artificial Sequence: Synthetic oligonucleotide
gaggggtagggaagcccttc

SEQ ID NO: 8320 - DNA, 20 bp, Artificial Sequence
  Description of Artificial Sequence: Synthetic oligonucleotide
aggggtagggaagcccttca

SEQ ID NO: 8321 - DNA, 20 bp, Artificial Sequence
  Description of Artificial Sequence: Synthetic oligonucleotide
ggggtagggaagcccttcac

SEQ ID NO: 8322 - DNA, 20 bp, Artificial Sequence
  Description of Artificial Sequence: Synthetic oligonucleotide
gggtagggaagcccttcacc

SEQ ID NO: 8323 - DNA, 20 bp, Artificial Sequence
  Description of Artificial Sequence: Synthetic oligonucleotide
ggtagggaagcccttcacct

SEQ ID NO: 8324 - DNA, 20 bp, Artificial Sequence
  Description of Artificial Sequence: Synthetic oligonucleotide
gtagggaagcccttcacctg

SEQ ID NO: 8325 - DNA, 20 bp, Artificial Sequence
  Description of Artificial Sequence: Synthetic oligonucleotide
tagggaagcccttcacctgg

SEQ ID NO: 8326 - DNA, 20 bp, Artificial Sequence
  Description of Artificial Sequence: Synthetic oligonucleotide
agggaagcccttcacctgga

SEQ ID NO: 8327 - DNA, 20 bp, Artificial Sequence
  Description of Artificial Sequence: Synthetic oligonucleotide
gggaagcccttcacctggat

SEQ ID NO: 8328 - DNA, 20 bp, Artificial Sequence
  Description of Artificial Sequence: Synthetic oligonucleotide
ggaagcccttcacctggata

SEQ ID NO: 8329 - DNA, 20 bp, Artificial Sequence
  Description of Artificial Sequence: Synthetic oligonucleotide
gaagcccttcacctggatag

SEQ ID NO: 8330 - DNA, 20 bp, Artificial Sequence
  Description of Artificial Sequence: Synthetic oligonucleotide
aagcccttcacctggatagc

SEQ ID NO: 8331 - DNA, 20 bp, Artificial Sequence
  Description of Artificial Sequence: Synthetic oligonucleotide
agcccttcacctggatagca

SEQ ID NO: 8332 - DNA, 20 bp, Artificial Sequence
  Description of Artificial Sequence: Synthetic oligonucleotide
gcccttcacctggatagcat

SEQ ID NO: 8333 - DNA, 20 bp, Artificial Sequence
  Description of Artificial Sequence: Synthetic oligonucleotide
cccttcacctggatagcatt

SEQ ID NO: 8334 - DNA, 20 bp, Artificial Sequence
  Description of Artificial Sequence: Synthetic oligonucleotide
ccttcacctggatagcatta

SEQ ID NO: 8335 - DNA, 20 bp, Artificial Sequence
  Description of Artificial Sequence: Synthetic oligonucleotide
cttcacctggatagcattag

SEQ ID NO: 8336 - DNA, 20 bp, Artificial Sequence
  Description of Artificial Sequence: Synthetic oligonucleotide
ttcacctggatagcattagt

SEQ ID NO: 8337 - DNA, 20 bp, Artificial Sequence
  Description of Artificial Sequence: Synthetic oligonucleotide
tcacctggatagcattagtg

SEQ ID NO: 8338 - DNA, 20 bp, Artificial Sequence
  Description of Artificial Sequence: Synthetic oligonucleotide
cacctggatagcattagtgg

SEQ ID NO: 8339 - DNA, 20 bp, Artificial Sequence
  Description of Artificial Sequence: Synthetic oligonucleotide
acctggatagcattagtggg

SEQ ID NO: 8340 - DNA, 20 bp, Artificial Sequence
  Description of Artificial Sequence: Synthetic oligonucleotide
cctggatagcattagtggga

SEQ ID NO: 8341 - DNA, 20 bp, Artificial Sequence
  Description of Artificial Sequence: Synthetic oligonucleotide
ctggatagcattagtgggac

SEQ ID NO: 8342 - DNA, 20 bp, Artificial Sequence
  Description of Artificial Sequence: Synthetic oligonucleotide
tggatagcattagtgggacg

SEQ ID NO: 8343 - DNA, 20 bp, Artificial Sequence
  Description of Artificial Sequence: Synthetic oligonucleotide
ggatagcattagtgggacgt

SEQ ID NO: 8344 - DNA, 20 bp, Artificial Sequence
  Description of Artificial Sequence: Synthetic oligonucleotide
gatagcattagtgggacgtt

SEQ ID NO: 8345 - DNA, 20 bp, Artificial Sequence
  Description of Artificial Sequence: Synthetic oligonucleotide
atagcattagtgggacgttc

SEQ ID NO: 8346 - DNA, 20 bp, Artificial Sequence
  Description of Artificial Sequence: Synthetic oligonucleotide
tagcattagtgggacgttcc

SEQ ID NO: 8347 - DNA, 20 bp, Artificial Sequence
  Description of Artificial Sequence: Synthetic oligonucleotide
agcattagtgggacgttcca

SEQ ID NO: 8348 - DNA, 20 bp, Artificial Sequence
  Description of Artificial Sequence: Synthetic oligonucleotide
gcattagtgggacgttccaa

SEQ ID NO: 8349 - DNA, 20 bp, Artificial Sequence
  Description of Artificial Sequence: Synthetic oligonucleotide
cattagtgggacgttccaac

SEQ ID NO: 8350 - DNA, 20 bp, Artificial Sequence
  Description of Artificial Sequence: Synthetic oligonucleotide
attagtgggacgttccaaca

SEQ ID NO: 8351 - DNA, 20 bp, Artificial Sequence
  Description of Artificial Sequence: Synthetic oligonucleotide
ttagtgggacgttccaacag

SEQ ID NO: 8352 - DNA, 20 bp, Artificial Sequence
  Description of Artificial Sequence: Synthetic oligonucleotide
tagtgggacgttccaacagg

SEQ ID NO: 8353 - DNA, 20 bp, Artificial Sequence
  Description of Artificial Sequence: Synthetic oligonucleotide
agtgggacgttccaacaggt

SEQ ID NO: 8354 - DNA, 20 bp, Artificial Sequence
  Description of Artificial Sequence: Synthetic oligonucleotide
gtgggacgttccaacaggtg

SEQ ID NO: 8355 - DNA, 20 bp, Artificial Sequence
  Description of Artificial Sequence: Synthetic oligonucleotide
tgggacgttccaacaggtgg

SEQ ID NO: 8356 - DNA, 20 bp, Artificial Sequence
  Description of Artificial Sequence: Synthetic oligonucleotide
gggacgttccaacaggtggt

SEQ ID NO: 8357 - DNA, 20 bp, Artificial Sequence
  Description of Artificial Sequence: Synthetic oligonucleotide
ggacgttccaacaggtggtt

SEQ ID NO: 8358 - DNA, 20 bp, Artificial Sequence
  Description of Artificial Sequence: Synthetic oligonucleotide
gacgttccaacaggtggttt

SEQ ID NO: 8359 - DNA, 20 bp, Artificial Sequence
  Description of Artificial Sequence: Synthetic oligonucleotide
acgttccaacaggtggtttc

SEQ ID NO: 8360 - DNA, 20 bp, Artificial Sequence
  Description of Artificial Sequence: Synthetic oligonucleotide
cgttccaacaggtggtttca

SEQ ID NO: 8361 - DNA, 20 bp, Artificial Sequence
  Description of Artificial Sequence: Synthetic oligonucleotide
gttccaacaggtggtttcag

SEQ ID NO: 8362 - DNA, 20 bp, Artificial Sequence
  Description of Artificial Sequence: Synthetic oligonucleotide
ttccaacaggtggtttcagg

SEQ ID NO: 8363 - DNA, 20 bp, Artificial Sequence
  Description of Artificial Sequence: Synthetic oligonucleotide
tccaacaggtggtttcaggt

SEQ ID NO: 8364 - DNA, 20 bp, Artificial Sequence
  Description of Artificial Sequence: Synthetic oligonucleotide
ccaacaggtggtttcaggtt

SEQ ID NO: 8365 - DNA, 20 bp, Artificial Sequence
  Description of Artificial Sequence: Synthetic oligonucleotide
caacaggtggtttcaggtta

SEQ ID NO: 8366 - DNA, 20 bp, Artificial Sequence
  Description of Artificial Sequence: Synthetic oligonucleotide
aacaggtggtttcaggttaa

SEQ ID NO: 8367 - DNA, 20 bp, Artificial Sequence
  Description of Artificial Sequence: Synthetic oligonucleotide
acaggtggtttcaggttaac

SEQ ID NO: 8368 - DNA, 20 bp, Artificial Sequence
  Description of Artificial Sequence: Synthetic oligonucleotide
caggtggtttcaggttaact

SEQ ID NO: 8369 - DNA, 20 bp, Artificial Sequence
  Description of Artificial Sequence: Synthetic oligonucleotide
aggtggtttcaggttaactc

SEQ ID NO: 8370 - DNA, 20 bp, Artificial Sequence
  Description of Artificial Sequence: Synthetic oligonucleotide
ggtggtttcaggttaactct

SEQ ID NO: 8371 - DNA, 20 bp, Artificial Sequence
  Description of Artificial Sequence: Synthetic oligonucleotide
gtggtttcaggttaactctg

SEQ ID NO: 8372 - DNA, 20 bp, Artificial Sequence
  Description of Artificial Sequence: Synthetic oligonucleotide
tggtttcaggttaactctga

SEQ ID NO: 8373 - DNA, 20 bp, Artificial Sequence
  Description of Artificial Sequence: Synthetic oligonucleotide
ggtttcaggttaactctgaa

SEQ ID NO: 8374 - DNA, 20 bp, Artificial Sequence
  Description of Artificial Sequence: Synthetic oligonucleotide
gtttcaggttaactctgaaa

SEQ ID NO: 8375 - DNA, 20 bp, Artificial Sequence
  Description of Artificial Sequence: Synthetic oligonucleotide
tttcaggttaactctgaaat

SEQ ID NO: 8376 - DNA, 20 bp, Artificial Sequence
  Description of Artificial Sequence: Synthetic oligonucleotide
ttcaggttaactctgaaata

SEQ ID NO: 8377 - DNA, 20 bp, Artificial Sequence
  Description of Artificial Sequence: Synthetic oligonucleotide
tcaggttaactctgaaataa

SEQ ID NO: 8378 - DNA, 20 bp, Artificial Sequence
  Description of Artificial Sequence: Synthetic oligonucleotide
caggttaactctgaaataaa

SEQ ID NO: 8379 - DNA, 20 bp, Artificial Sequence
  Description of Artificial Sequence: Synthetic oligonucleotide
aggttaactctgaaataaat

SEQ ID NO: 8380 - DNA, 20 bp, Artificial Sequence
  Description of Artificial Sequence: Synthetic oligonucleotide
ggttaactctgaaataaatt

SEQ ID NO: 8381 - DNA, 20 bp, Artificial Sequence
  Description of Artificial Sequence: Synthetic oligonucleotide
gttaactctgaaataaatta

SEQ ID NO: 8382 - DNA, 20 bp, Artificial Sequence
  Description of Artificial Sequence: Synthetic oligonucleotide
ttaactctgaaataaattat

SEQ ID NO: 8383 - DNA, 20 bp, Artificial Sequence
  Description of Artificial Sequence: Synthetic oligonucleotide
taactctgaaataaattatt

SEQ ID NO: 8384 - DNA, 20 bp, Artificial Sequence
  Description of Artificial Sequence: Synthetic oligonucleotide
aactctgaaataaattattc

SEQ ID NO: 8385 - DNA, 20 bp, Artificial Sequence
  Description of Artificial Sequence: Synthetic oligonucleotide
actctgaaataaattattct

SEQ ID NO: 8386 - DNA, 20 bp, Artificial Sequence
  Description of Artificial Sequence: Synthetic oligonucleotide
ctctgaaataaattattctg

SEQ ID NO: 8387 - DNA, 20 bp, Artificial Sequence
  Description of Artificial Sequence: Synthetic oligonucleotide
tctgaaataaattattctgc

SEQ ID NO: 8388 - DNA, 20 bp, Artificial Sequence
  Description of Artificial Sequence: Synthetic oligonucleotide
ctgaaataaattattctgct

SEQ ID NO: 8389 - DNA, 20 bp, Artificial Sequence
  Description of Artificial Sequence: Synthetic oligonucleotide
tgaaataaattattctgcta

SEQ ID NO: 8390 - DNA, 20 bp, Artificial Sequence
  Description of Artificial Sequence: Synthetic oligonucleotide
gaaataaattattctgctat

SEQ ID NO: 8391 - DNA, 20 bp, Artificial Sequence
  Description of Artificial Sequence: Synthetic oligonucleotide
aaataaattattctgctata

SEQ ID NO: 8392 - DNA, 20 bp, Artificial Sequence
  Description of Artificial Sequence: Synthetic oligonucleotide
aataaattattctgctatag

SEQ ID NO: 8393 - DNA, 20 bp, Artificial Sequence
  Description of Artificial Sequence: Synthetic oligonucleotide
ataaattattctgctatagc

SEQ ID NO: 8394 - DNA, 20 bp, Artificial Sequence
  Description of Artificial Sequence: Synthetic oligonucleotide
taaattattctgctatagct

SEQ ID NO: 8395 - DNA, 20 bp, Artificial Sequence
  Description of Artificial Sequence: Synthetic oligonucleotide
aaattattctgctatagctg

SEQ ID NO: 8396 - DNA, 20 bp, Artificial Sequence
  Description of Artificial Sequence: Synthetic oligonucleotide
aattattctgctatagctgg

SEQ ID NO: 8397 - DNA, 20 bp, Artificial Sequence
  Description of Artificial Sequence: Synthetic oligonucleotide
attattctgctatagctggg

SEQ ID NO: 8398 - DNA, 20 bp, Artificial Sequence
  Description of Artificial Sequence: Synthetic oligonucleotide
ttattctgctatagctgggc

SEQ ID NO: 8399 - DNA, 20 bp, Artificial Sequence
  Description of Artificial Sequence: Synthetic oligonucleotide
tattctgctatagctgggcc

SEQ ID NO: 8400 - DNA, 20 bp, Artificial Sequence
  Description of Artificial Sequence: Synthetic oligonucleotide
attctgctatagctgggcca

SEQ ID NO: 8401 - DNA, 20 bp, Artificial Sequence
  Description of Artificial Sequence: Synthetic oligonucleotide
ttctgctatagctgggccat

SEQ ID NO: 8402 - DNA, 20 bp, Artificial Sequence
  Description of Artificial Sequence: Synthetic oligonucleotide
tctgctatagctgggccatg

SEQ ID NO: 8403 - DNA, 20 bp, Artificial Sequence
  Description of Artificial Sequence: Synthetic oligonucleotide
ctgctatagctgggccatga

SEQ ID NO: 8404 - DNA, 20 bp, Artificial Sequence
  Description of Artificial Sequence: Synthetic oligonucleotide
tgctatagctgggccatgaa

SEQ ID NO: 8405 - DNA, 20 bp, Artificial Sequence
  Description of Artificial Sequence: Synthetic oligonucleotide
gctatagctgggccatgaat

SEQ ID NO: 8406 - DNA, 20 bp, Artificial Sequence
  Description of Artificial Sequence: Synthetic oligonucleotide
ctatagctgggccatgaatt

SEQ ID NO: 8407 - DNA, 20 bp, Artificial Sequence
  Description of Artificial Sequence: Synthetic oligonucleotide
tatagctgggccatgaattc

SEQ ID NO: 8408 - DNA, 20 bp, Artificial Sequence
  Description of Artificial Sequence: Synthetic oligonucleotide
atagctgggccatgaattct

SEQ ID NO: 8409 - DNA, 20 bp, Artificial Sequence
  Description of Artificial Sequence: Synthetic oligonucleotide
tagctgggccatgaattcta

SEQ ID NO: 8410 - DNA, 20 bp, Artificial Sequence
  Description of Artificial Sequence: Synthetic oligonucleotide
agctgggccatgaattctag

SEQ ID NO: 8411 - DNA, 20 bp, Artificial Sequence
  Description of Artificial Sequence: Synthetic oligonucleotide
gctgggccatgaattctaga

SEQ ID NO: 8412 - DNA, 20 bp, Artificial Sequence
  Description of Artificial Sequence: Synthetic oligonucleotide
ctgggccatgaattctagaa

SEQ ID NO: 8413 - DNA, 20 bp, Artificial Sequence
  Description of Artificial Sequence: Synthetic oligonucleotide
tgggccatgaattctagaaa

SEQ ID NO: 8414 - DNA, 20 bp, Artificial Sequence
  Description of Artificial Sequence: Synthetic oligonucleotide
gggccatgaattctagaaat

SEQ ID NO: 8415 - DNA, 20 bp, Artificial Sequence
  Description of Artificial Sequence: Synthetic oligonucleotide
ggccatgaattctagaaatg

SEQ ID NO: 8416 - DNA, 20 bp, Artificial Sequence
  Description of Artificial Sequence: Synthetic oligonucleotide
gccatgaattctagaaatgt

SEQ ID NO: 8417 - DNA, 20 bp, Artificial Sequence
  Description of Artificial Sequence: Synthetic oligonucleotide
ccatgaattctagaaatgtt

SEQ ID NO: 8418 - DNA, 20 bp, Artificial Sequence
  Description of Artificial Sequence: Synthetic oligonucleotide
catgaattctagaaatgtta

SEQ ID NO: 8419 - DNA, 20 bp, Artificial Sequence
  Description of Artificial Sequence: Synthetic oligonucleotide
atgaattctagaaatgttac

SEQ ID NO: 8420 - DNA, 20 bp, Artificial Sequence
  Description of Artificial Sequence: Synthetic oligonucleotide
tgaattctagaaatgttaca

SEQ ID NO: 8421 - DNA, 20 bp, Artificial Sequence
  Description of Artificial Sequence: Synthetic oligonucleotide
gaattctagaaatgttacag

SEQ ID NO: 8422 - DNA, 20 bp, Artificial Sequence
  Description of Artificial Sequence: Synthetic oligonucleotide
aattctagaaatgttacagt

SEQ ID NO: 8423 - DNA, 20 bp, Artificial Sequence
  Description of Artificial Sequence: Synthetic oligonucleotide
attctagaaatgttacagtg

SEQ ID NO: 8424 - DNA, 20 bp, Artificial Sequence
  Description of Artificial Sequence: Synthetic oligonucleotide
ttctagaaatgttacagtgt

SEQ ID NO: 8425 - DNA, 20 bp, Artificial Sequence
  Description of Artificial Sequence: Synthetic oligonucleotide
tctagaaatgttacagtgta

SEQ ID NO: 8426 - DNA, 20 bp, Artificial Sequence
  Description of Artificial Sequence: Synthetic oligonucleotide
ctagaaatgttacagtgtat

SEQ ID NO: 8427 - DNA, 20 bp, Artificial Sequence
  Description of Artificial Sequence: Synthetic oligonucleotide
tagaaatgttacagtgtatg

SEQ ID NO: 8428 - DNA, 20 bp, Artificial Sequence
  Description of Artificial Sequence: Synthetic oligonucleotide
agaaatgttacagtgtatga

SEQ ID NO: 8429 - DNA, 20 bp, Artificial Sequence
  Description of Artificial Sequence: Synthetic oligonucleotide
gaaatgttacagtgtatgag

SEQ ID NO: 8430 - DNA, 20 bp, Artificial Sequence
  Description of Artificial Sequence: Synthetic oligonucleotide
aaatgttacagtgtatgagg

SEQ ID NO: 8431 - DNA, 20 bp, Artificial Sequence
  Description of Artificial Sequence: Synthetic oligonucleotide
aatgttacagtgtatgaggg

SEQ ID NO: 8432 - DNA, 20 bp, Artificial Sequence
  Description of Artificial Sequence: Synthetic oligonucleotide
atgttacagtgtatgagggc

SEQ ID NO: 8433 - DNA, 20 bp, Artificial Sequence
  Description of Artificial Sequence: Synthetic oligonucleotide
tgttacagtgtatgagggcc

SEQ ID NO: 8434 - DNA, 20 bp, Artificial Sequence
  Description of Artificial Sequence: Synthetic oligonucleotide
gttacagtgtatgagggcca

SEQ ID NO: 8435 - DNA, 20 bp, Artificial Sequence
  Description of Artificial Sequence: Synthetic oligonucleotide
ttacagtgtatgagggccac

SEQ ID NO: 8436 - DNA, 20 bp, Artificial Sequence
  Description of Artificial Sequence: Synthetic oligonucleotide
tacagtgtatgagggccacg

SEQ ID NO: 8437 - DNA, 20 bp, Artificial Sequence
  Description of Artificial Sequence: Synthetic oligonucleotide
acagtgtatgagggccacgt

SEQ ID NO: 8438 - DNA, 20 bp, Artificial Sequence
  Description of Artificial Sequence: Synthetic oligonucleotide
cagtgtatgagggccacgta

SEQ ID NO: 8439 - DNA, 20 bp, Artificial Sequence
  Description of Artificial Sequence: Synthetic oligonucleotide
agtgtatgagggccacgtaa

SEQ ID NO: 8440 - DNA, 20 bp, Artificial Sequence
  Description of Artificial Sequence: Synthetic oligonucleotide
gtgtatgagggccacgtaac

SEQ ID NO: 8441 - DNA, 20 bp, Artificial Sequence
  Description of Artificial Sequence: Synthetic oligonucleotide
tgtatgagggccacgtaaca

SEQ ID NO: 8442 - DNA, 20 bp, Artificial Sequence
  Description of Artificial Sequence: Synthetic oligonucleotide
gtatgagggccacgtaacag

SEQ ID NO: 8443 - DNA, 20 bp, Artificial Sequence
  Description of Artificial Sequence: Synthetic oligonucleotide
tatgagggccacgtaacaga

SEQ ID NO: 8444 - DNA, 20 bp, Artificial Sequence
  Description of Artificial Sequence: Synthetic oligonucleotide
atgagggccacgtaacagat

SEQ ID NO: 8445 - DNA, 20 bp, Artificial Sequence
  Description of Artificial Sequence: Synthetic oligonucleotide
tgagggccacgtaacagata

SEQ ID NO: 8446 - DNA, 20 bp, Artificial Sequence
  Description of Artificial Sequence: Synthetic oligonucleotide
gagggccacgtaacagatac

SEQ ID NO: 8447 - DNA, 20 bp, Artificial Sequence
  Description of Artificial Sequence: Synthetic oligonucleotide
agggccacgtaacagatact

SEQ ID NO: 8448 - DNA, 20 bp, Artificial Sequence
  Description of Artificial Sequence: Synthetic oligonucleotide
gggccacgtaacagatactc

SEQ ID NO: 8449 - DNA, 20 bp, Artificial Sequence
  Description of Artificial Sequence: Synthetic oligonucleotide
ggccacgtaacagatactcc

SEQ ID NO: 8450 - DNA, 20 bp, Artificial Sequence
  Description of Artificial Sequence: Synthetic oligonucleotide
gccacgtaacagatactcct

SEQ ID NO: 8451 - DNA, 20 bp, Artificial Sequence
  Description of Artificial Sequence: Synthetic oligonucleotide
ccacgtaacagatactcctg

SEQ ID NO: 8452 - DNA, 20 bp, Artificial Sequence
  Description of Artificial Sequence: Synthetic oligonucleotide
cacgtaacagatactcctgt

SEQ ID NO: 8453 - DNA, 20 bp, Artificial Sequence
  Description of Artificial Sequence: Synthetic oligonucleotide
acgtaacagatactcctgtc

SEQ ID NO: 8454 - DNA, 20 bp, Artificial Sequence
  Description of Artificial Sequence: Synthetic oligonucleotide
cgtaacagatactcctgtca

SEQ ID NO: 8455 - DNA, 20 bp, Artificial Sequence
  Description of Artificial Sequence: Synthetic oligonucleotide
gtaacagatactcctgtcag

SEQ ID NO: 8456 - DNA, 20 bp, Artificial Sequence
  Description of Artificial Sequence: Synthetic oligonucleotide
taacagatactcctgtcaga

SEQ ID NO: 8457 - DNA, 20 bp, Artificial Sequence
  Description of Artificial Sequence: Synthetic oligonucleotide
aacagatactcctgtcagat

SEQ ID NO: 8458 - DNA, 20 bp, Artificial Sequence
  Description of Artificial Sequence: Synthetic oligonucleotide
acagatactcctgtcagata

SEQ ID NO: 8459 - DNA, 20 bp, Artificial Sequence
  Description of Artificial Sequence: Synthetic oligonucleotide
cagatactcctgtcagatag

SEQ ID NO: 8460 - DNA, 20 bp, Artificial Sequence
  Description of Artificial Sequence: Synthetic oligonucleotide
agatactcctgtcagataga

SEQ ID NO: 8461 - DNA, 20 bp, Artificial Sequence
  Description of Artificial Sequence: Synthetic oligonucleotide
gatactcctgtcagatagat

SEQ ID NO: 8462 - DNA, 20 bp, Artificial Sequence
  Description of Artificial Sequence: Synthetic oligonucleotide
atactcctgtcagatagatt

SEQ ID NO: 8463 - DNA, 20 bp, Artificial Sequence
  Description of Artificial Sequence: Synthetic oligonucleotide
tactcctgtcagatagattc

SEQ ID NO: 8464 - DNA, 20 bp, Artificial Sequence
  Description of Artificial Sequence: Synthetic oligonucleotide
actcctgtcagatagattca

SEQ ID NO: 8465 - DNA, 20 bp, Artificial Sequence
  Description of Artificial Sequence: Synthetic oligonucleotide
ctcctgtcagatagattcag

SEQ ID NO: 8466 - DNA, 20 bp, Artificial Sequence
  Description of Artificial Sequence: Synthetic oligonucleotide
tcctgtcagatagattcaga

SEQ ID NO: 8467 - DNA, 20 bp, Artificial Sequence
  Description of Artificial Sequence: Synthetic oligonucleotide
cctgtcagatagattcagac

SEQ ID NO: 8468 - DNA, 20 bp, Artificial Sequence
  Description of Artificial Sequence: Synthetic oligonucleotide
ctgtcagatagattcagact

SEQ ID NO: 8469 - DNA, 20 bp, Artificial Sequence
  Description of Artificial Sequence: Synthetic oligonucleotide
tgtcagatagattcagactt

SEQ ID NO: 8470 - DNA, 20 bp, Artificial Sequence
  Description of Artificial Sequence: Synthetic oligonucleotide
gtcagatagattcagacttc

SEQ ID NO: 8471 - DNA, 20 bp, Artificial Sequence
  Description of Artificial Sequence: Synthetic oligonucleotide
tcagatagattcagacttct

SEQ ID NO: 8472 - DNA, 20 bp, Artificial Sequence
  Description of Artificial Sequence: Synthetic oligonucleotide
cagatagattcagacttctt

SEQ ID NO: 8473 - DNA, 20 bp, Artificial Sequence
  Description of Artificial Sequence: Synthetic oligonucleotide
agatagattcagacttctta

SEQ ID NO: 8474 - DNA, 20 bp, Artificial Sequence
  Description of Artificial Sequence: Synthetic oligonucleotide
gatagattcagacttcttag

SEQ ID NO: 8475 - DNA, 20 bp, Artificial Sequence
  Description of Artificial Sequence: Synthetic oligonucleotide
atagattcagacttcttaga

SEQ ID NO: 8476 - DNA, 20 bp, Artificial Sequence
  Description of Artificial Sequence: Synthetic oligonucleotide
tagattcagacttcttagac

SEQ ID NO: 8477 - DNA, 20 bp, Artificial Sequence
  Description of Artificial Sequence: Synthetic oligonucleotide
agattcagacttcttagaca

SEQ ID NO: 8478 - DNA, 20 bp, Artificial Sequence
  Description of Artificial Sequence: Synthetic oligonucleotide
gattcagacttcttagacag

SEQ ID NO: 8479 - DNA, 20 bp, Artificial Sequence
  Description of Artificial Sequence: Synthetic oligonucleotide
attcagacttcttagacagc

SEQ ID NO: 8480 - DNA, 20 bp, Artificial Sequence
  Description of Artificial Sequence: Synthetic oligonucleotide
ttcagacttcttagacagcc

SEQ ID NO: 8481 - DNA, 20 bp, Artificial Sequence
  Description of Artificial Sequence: Synthetic oligonucleotide
tcagacttcttagacagccg

SEQ ID NO: 8482 - DNA, 20 bp, Artificial Sequence
  Description of Artificial Sequence: Synthetic oligonucleotide
cagacttcttagacagccgc

SEQ ID NO: 8483 - DNA, 20 bp, Artificial Sequence
  Description of Artificial Sequence: Synthetic oligonucleotide
agacttcttagacagccgcc

SEQ ID NO: 8484 - DNA, 20 bp, Artificial Sequence
  Description of Artificial Sequence: Synthetic oligonucleotide
gacttcttagacagccgcca

SEQ ID NO: 8485 - DNA, 20 bp, Artificial Sequence
  Description of Artificial Sequence: Synthetic oligonucleotide
acttcttagacagccgccac

SEQ ID NO: 8486 - DNA, 20 bp, Artificial Sequence
  Description of Artificial Sequence: Synthetic oligonucleotide
cttcttagacagccgccact

SEQ ID NO: 8487 - DNA, 20 bp, Artificial Sequence
  Description of Artificial Sequence: Synthetic oligonucleotide
ttcttagacagccgccacta

SEQ ID NO: 8488 - DNA, 20 bp, Artificial Sequence
  Description of Artificial Sequence: Synthetic oligonucleotide
tcttagacagccgccactat

SEQ ID NO: 8489 - DNA, 20 bp, Artificial Sequence
  Description of Artificial Sequence: Synthetic oligonucleotide
cttagacagccgccactata

SEQ ID NO: 8490 - DNA, 20 bp, Artificial Sequence
  Description of Artificial Sequence: Synthetic oligonucleotide
ttagacagccgccactataa

SEQ ID NO: 8491 - DNA, 20 bp, Artificial Sequence
  Description of Artificial Sequence: Synthetic oligonucleotide
tagacagccgccactataac

SEQ ID NO: 8492 - DNA, 20 bp, Artificial Sequence
  Description of Artificial Sequence: Synthetic oligonucleotide
agacagccgccactataaca

SEQ ID NO: 8493 - DNA, 20 bp, Artificial Sequence
  Description of Artificial Sequence: Synthetic oligonucleotide
gacagccgccactataacaa

SEQ ID NO: 8494 - DNA, 20 bp, Artificial Sequence
  Description of Artificial Sequence: Synthetic oligonucleotide
acagccgccactataacaaa

SEQ ID NO: 8495 - DNA, 20 bp, Artificial Sequence
  Description of Artificial Sequence: Synthetic oligonucleotide
cagccgccactataacaaat

SEQ ID NO: 8496 - DNA, 20 bp, Artificial Sequence
  Description of Artificial Sequence: Synthetic oligonucleotide
agccgccactataacaaatc

SEQ ID NO: 8497 - DNA, 20 bp, Artificial Sequence
  Description of Artificial Sequence: Synthetic oligonucleotide
gccgccactataacaaatca

SEQ ID NO: 8498 - DNA, 20 bp, Artificial Sequence
  Description of Artificial Sequence: Synthetic oligonucleotide
ccgccactataacaaatcag

SEQ ID NO: 8499 - DNA, 20 bp, Artificial Sequence
  Description of Artificial Sequence: Synthetic oligonucleotide
cgccactataacaaatcagt

SEQ ID NO: 8500 - DNA, 20 bp, Artificial Sequence
  Description of Artificial Sequence: Synthetic oligonucleotide
gccactataacaaatcagtc

SEQ ID NO: 8501 - DNA, 20 bp, Artificial Sequence
  Description of Artificial Sequence: Synthetic oligonucleotide
ccactataacaaatcagtcg

SEQ ID NO: 8502 - DNA, 20 bp, Artificial Sequence
  Description of Artificial Sequence: Synthetic oligonucleotide
cactataacaaatcagtcgt

SEQ ID NO: 8503 - DNA, 20 bp, Artificial Sequence
  Description of Artificial Sequence: Synthetic oligonucleotide
actataacaaatcagtcgtg

SEQ ID NO: 8504 - DNA, 20 bp, Artificial Sequence
  Description of Artificial Sequence: Synthetic oligonucleotide
ctataacaaatcagtcgtga

SEQ ID NO: 8505 - DNA, 20 bp, Artificial Sequence
  Description of Artificial Sequence: Synthetic oligonucleotide
tataacaaatcagtcgtgaa

SEQ ID NO: 8506 - DNA, 20 bp, Artificial Sequence
  Description of Artificial Sequence: Synthetic oligonucleotide
ataacaaatcagtcgtgaat

SEQ ID NO: 8507 - DNA, 20 bp, Artificial Sequence
  Description of Artificial Sequence: Synthetic oligonucleotide
taacaaatcagtcgtgaata

SEQ ID NO: 8508 - DNA, 20 bp, Artificial Sequence
  Description of Artificial Sequence: Synthetic oligonucleotide
aacaaatcagtcgtgaatat

SEQ ID NO: 8509 - DNA, 20 bp, Artificial Sequence
  Description of Artificial Sequence: Synthetic oligonucleotide
acaaatcagtcgtgaatatc

SEQ ID NO: 8510 - DNA, 20 bp, Artificial Sequence
  Description of Artificial Sequence: Synthetic oligonucleotide
caaatcagtcgtgaatatct

SEQ ID NO: 8511 - DNA, 20 bp, Artificial Sequence
  Description of Artificial Sequence: Synthetic oligonucleotide
aaatcagtcgtgaatatctc

SEQ ID NO: 8512 - DNA, 20 bp, Artificial Sequence
  Description of Artificial Sequence: Synthetic oligonucleotide
aatcagtcgtgaatatctca

SEQ ID NO: 8513 - DNA, 20 bp, Artificial Sequence
  Description of Artificial Sequence: Synthetic oligonucleotide
atcagtcgtgaatatctcat

SEQ ID NO: 8514 - DNA, 20 bp, Artificial Sequence
  Description of Artificial Sequence: Synthetic oligonucleotide
tcagtcgtgaatatctcata

SEQ ID NO: 8515 - DNA, 20 bp, Artificial Sequence
  Description of Artificial Sequence: Synthetic oligonucleotide
cagtcgtgaatatctcatag

SEQ ID NO: 8516 - DNA, 20 bp, Artificial Sequence
  Description of Artificial Sequence: Synthetic oligonucleotide
agtcgtgaatatctcataga

SEQ ID NO: 8517 - DNA, 20 bp, Artificial Sequence
  Description of Artificial Sequence: Synthetic oligonucleotide
gtcgtgaatatctcatagag

SEQ ID NO: 8518 - DNA, 20 bp, Artificial Sequence
  Description of Artificial Sequence: Synthetic oligonucleotide
tcgtgaatatctcatagagt

SEQ ID NO: 8519 - DNA, 20 bp, Artificial Sequence
  Description of Artificial Sequence: Synthetic oligonucleotide
cgtgaatatctcatagagtc

SEQ ID NO: 8520 - DNA, 20 bp, Artificial Sequence
  Description of Artificial Sequence: Synthetic oligonucleotide
gtgaatatctcatagagtct

SEQ ID NO: 8521 - DNA, 20 bp, Artificial Sequence
  Description of Artificial Sequence: Synthetic oligonucleotide
tgaatatctcatagagtctg

SEQ ID NO: 8522 - DNA, 20 bp, Artificial Sequence
  Description of Artificial Sequence: Synthetic oligonucleotide
gaatatctcatagagtctgg

SEQ ID NO: 8523 - DNA, 20 bp, Artificial Sequence
  Description of Artificial Sequence: Synthetic oligonucleotide
aatatctcatagagtctggt

SEQ ID NO: 8524 - DNA, 20 bp, Artificial Sequence
  Description of Artificial Sequence: Synthetic oligonucleotide
atatctcatagagtctggtt

SEQ ID NO: 8525 - DNA, 20 bp, Artificial Sequence
  Description of Artificial Sequence: Synthetic oligonucleotide
tatctcatagagtctggttt

SEQ ID NO: 8526 - DNA, 20 bp, Artificial Sequence
  Description of Artificial Sequence: Synthetic oligonucleotide
atctcatagagtctggtttt

SEQ ID NO: 8527 - DNA, 20 bp, Artificial Sequence
  Description of Artificial Sequence: Synthetic oligonucleotide
tctcatagagtctggttttg

SEQ ID NO: 8528 - DNA, 20 bp, Artificial Sequence
  Description of Artificial Sequence: Synthetic oligonucleotide
ctcatagagtctggttttgt

SEQ ID NO: 8529 - DNA, 20 bp, Artificial Sequence
  Description of Artificial Sequence: Synthetic oligonucleotide
tcatagagtctggttttgtt

SEQ ID NO: 8530 - DNA, 20 bp, Artificial Sequence
  Description of Artificial Sequence: Synthetic oligonucleotide
catagagtctggttttgttg

SEQ ID NO: 8531 - DNA, 20 bp, Artificial Sequence
  Description of Artificial Sequence: Synthetic oligonucleotide
atagagtctggttttgttga

SEQ ID NO: 8532 - DNA, 20 bp, Artificial Sequence
  Description of Artificial Sequence: Synthetic oligonucleotide
tagagtctggttttgttgat

SEQ ID NO: 8533 - DNA, 20 bp, Artificial Sequence
  Description of Artificial Sequence: Synthetic oligonucleotide
agagtctggttttgttgatg

SEQ ID NO: 8534 - DNA, 20 bp, Artificial Sequence
  Description of Artificial Sequence: Synthetic oligonucleotide
gagtctggttttgttgatgt

SEQ ID NO: 8535 - DNA, 20 bp, Artificial Sequence
  Description of Artificial Sequence: Synthetic oligonucleotide
agtctggttttgttgatgtt

SEQ ID NO: 8536 - DNA, 20 bp, Artificial Sequence
  Description of Artificial Sequence: Synthetic oligonucleotide
gtctggttttgttgatgttt

SEQ ID NO: 8537 - DNA, 20 bp, Artificial Sequence
  Description of Artificial Sequence: Synthetic oligonucleotide
tctggttttgttgatgtttc

SEQ ID NO: 8538 - DNA, 20 bp, Artificial Sequence
  Description of Artificial Sequence: Synthetic oligonucleotide
ctggttttgttgatgtttcc

SEQ ID NO: 8539 - DNA, 20 bp, Artificial Sequence
  Description of Artificial Sequence: Synthetic oligonucleotide
tggttttgttgatgtttcct

SEQ ID NO: 8540 - DNA, 20 bp, Artificial Sequence
  Description of Artificial Sequence: Synthetic oligonucleotide
ggttttgttgatgtttcctg

SEQ ID NO: 8541 - DNA, 20 bp, Artificial Sequence
  Description of Artificial Sequence: Synthetic oligonucleotide
gttttgttgatgtttcctgg

SEQ ID NO: 8542 - DNA, 20 bp, Artificial Sequence
  Description of Artificial Sequence: Synthetic oligonucleotide
ttttgttgatgtttcctggt

SEQ ID NO: 8543 - DNA, 20 bp, Artificial Sequence
  Description of Artificial Sequence: Synthetic oligonucleotide
tttgttgatgtttcctggtt

SEQ ID NO: 8544 - DNA, 20 bp, Artificial Sequence
  Description of Artificial Sequence: Synthetic oligonucleotide
ttgttgatgtttcctggttg

SEQ ID NO: 8545 - DNA, 20 bp, Artificial Sequence
  Description of Artificial Sequence: Synthetic oligonucleotide
tgttgatgtttcctggttgg

SEQ ID NO: 8546 - DNA, 20 bp, Artificial Sequence
  Description of Artificial Sequence: Synthetic oligonucleotide
gttgatgtttcctggttggt

SEQ ID NO: 8547 - DNA, 20 bp, Artificial Sequence
  Description of Artificial Sequence: Synthetic oligonucleotide
ttgatgtttcctggttggtt

SEQ ID NO: 8548 - DNA, 20 bp, Artificial Sequence
  Description of Artificial Sequence: Synthetic oligonucleotide
tgatgtttcctggttggttg

SEQ ID NO: 8549 - DNA, 20 bp, Artificial Sequence
  Description of Artificial Sequence: Synthetic oligonucleotide
gatgtttcctggttggttgt

SEQ ID NO: 8550 - DNA, 20 bp, Artificial Sequence
  Description of Artificial Sequence: Synthetic oligonucleotide
atgtttcctggttggttgtt

SEQ ID NO: 8551 - DNA, 20 bp, Artificial Sequence
  Description of Artificial Sequence: Synthetic oligonucleotide
tgtttcctggttggttgttt

SEQ ID NO: 8552 - DNA, 20 bp, Artificial Sequence
  Description of Artificial Sequence: Synthetic oligonucleotide
gtttcctggttggttgtttt

SEQ ID NO: 8553 - DNA, 20 bp, Artificial Sequence
  Description of Artificial Sequence: Synthetic oligonucleotide
tttcctggttggttgttttt

SEQ ID NO: 8554 - DNA, 20 bp, Artificial Sequence
  Description of Artificial Sequence: Synthetic oligonucleotide
ttcctggttggttgtttttg

SEQ ID NO: 8555 - DNA, 20 bp, Artificial Sequence
  Description of Artificial Sequence: Synthetic oligonucleotide
tcctggttggttgtttttgt

SEQ ID NO: 8556 - DNA, 20 bp, Artificial Sequence
  Description of Artificial Sequence: Synthetic oligonucleotide
cctggttggttgtttttgtt

SEQ ID NO: 8557 - DNA, 20 bp, Artificial Sequence
  Description of Artificial Sequence: Synthetic oligonucleotide
ctggttggttgtttttgttg

SEQ ID NO: 8558 - DNA, 20 bp, Artificial Sequence
  Description of Artificial Sequence: Synthetic oligonucleotide
tggttggttgtttttgttgt

SEQ ID NO: 8559 - DNA, 20 bp, Artificial Sequence
  Description of Artificial Sequence: Synthetic oligonucleotide
ggttggttgtttttgttgtt

SEQ ID NO: 8560 - DNA, 20 bp, Artificial Sequence
  Description of Artificial Sequence: Synthetic oligonucleotide
gttggttgtttttgttgttg

SEQ ID NO: 8561 - DNA, 20 bp, Artificial Sequence
  Description of Artificial Sequence: Synthetic oligonucleotide
ttggttgtttttgttgttgt

SEQ ID NO: 8562 - DNA, 20 bp, Artificial Sequence
  Description of Artificial Sequence: Synthetic oligonucleotide
tggttgtttttgttgttgtt

SEQ ID NO: 8563 - DNA, 20 bp, Artificial Sequence
  Description of Artificial Sequence: Synthetic oligonucleotide
ggttgtttttgttgttgttc

SEQ ID NO: 8564 - DNA, 20 bp, Artificial Sequence
  Description of Artificial Sequence: Synthetic oligonucleotide
gttgtttttgttgttgttca

SEQ ID NO: 8565 - DNA, 20 bp, Artificial Sequence
  Description of Artificial Sequence: Synthetic oligonucleotide
ttgtttttgttgttgttcag

SEQ ID NO: 8566 - DNA, 20 bp, Artificial Sequence
  Description of Artificial Sequence: Synthetic oligonucleotide
tgtttttgttgttgttcaga

SEQ ID NO: 8567 - DNA, 20 bp, Artificial Sequence
  Description of Artificial Sequence: Synthetic oligonucleotide
gtttttgttgttgttcagag

SEQ ID NO: 8568 - DNA, 20 bp, Artificial Sequence
  Description of Artificial Sequence: Synthetic oligonucleotide
tttttgttgttgttcagaga

SEQ ID NO: 8569 - DNA, 20 bp, Artificial Sequence
  Description of Artificial Sequence: Synthetic oligonucleotide
ttttgttgttgttcagagat

SEQ ID NO: 8570 - DNA, 20 bp, Artificial Sequence
  Description of Artificial Sequence: Synthetic oligonucleotide
tttgttgttgttcagagatg

SEQ ID NO: 8571 - DNA, 20 bp, Artificial Sequence
  Description of Artificial Sequence: Synthetic oligonucleotide
ttgttgttgttcagagatgg

SEQ ID NO: 8572 - DNA, 20 bp, Artificial Sequence
  Description of Artificial Sequence: Synthetic oligonucleotide
tgttgttgttcagagatggt

SEQ ID NO: 8573 - DNA, 20 bp, Artificial Sequence
  Description of Artificial Sequence: Synthetic oligonucleotide
gttgttgttcagagatggtg

SEQ ID NO: 8574 - DNA, 20 bp, Artificial Sequence
  Description of Artificial Sequence: Synthetic oligonucleotide
ttgttgttcagagatggtgg

SEQ ID NO: 8575 - DNA, 20 bp, Artificial Sequence
  Description of Artificial Sequence: Synthetic oligonucleotide
tgttgttcagagatggtggc

SEQ ID NO: 8576 - DNA, 20 bp, Artificial Sequence
  Description of Artificial Sequence: Synthetic oligonucleotide
gttgttcagagatggtggct

SEQ ID NO: 8577 - DNA, 20 bp, Artificial Sequence
  Description of Artificial Sequence: Synthetic oligonucleotide
ttgttcagagatggtggcta

SEQ ID NO: 8578 - DNA, 20 bp, Artificial Sequence
  Description of Artificial Sequence: Synthetic oligonucleotide
tgttcagagatggtggctac

SEQ ID NO: 8579 - DNA, 20 bp, Artificial Sequence
  Description of Artificial Sequence: Synthetic oligonucleotide
gttcagagatggtggctact

SEQ ID NO: 8580 - DNA, 20 bp, Artificial Sequence
  Description of Artificial Sequence: Synthetic oligonucleotide
ttcagagatggtggctactg

SEQ ID NO: 8581 - DNA, 20 bp, Artificial Sequence
  Description of Artificial Sequence: Synthetic oligonucleotide
tcagagatggtggctactgc

SEQ ID NO: 8582 - DNA, 20 bp, Artificial Sequence
  Description of Artificial Sequence: Synthetic oligonucleotide
cagagatggtggctactgcc

SEQ ID NO: 8583 - DNA, 20 bp, Artificial Sequence
  Description of Artificial Sequence: Synthetic oligonucleotide
agagatggtggctactgcca

SEQ ID NO: 8584 - DNA, 20 bp, Artificial Sequence
  Description of Artificial Sequence: Synthetic oligonucleotide
gagatggtggctactgccac

SEQ ID NO: 8585 - DNA, 20 bp, Artificial Sequence
  Description of Artificial Sequence: Synthetic oligonucleotide
agatggtggctactgccacc

SEQ ID NO: 8586 - DNA, 20 bp, Artificial Sequence
  Description of Artificial Sequence: Synthetic oligonucleotide
gatggtggctactgccacct

SEQ ID NO: 8587 - DNA, 20 bp, Artificial Sequence
  Description of Artificial Sequence: Synthetic oligonucleotide
atggtggctactgccacctg

SEQ ID NO: 8588 - DNA, 20 bp, Artificial Sequence
  Description of Artificial Sequence: Synthetic oligonucleotide
tggtggctactgccacctga

SEQ ID NO: 8589 - DNA, 20 bp, Artificial Sequence
  Description of Artificial Sequence: Synthetic oligonucleotide
ggtggctactgccacctgag

SEQ ID NO: 8590 - DNA, 20 bp, Artificial Sequence
  Description of Artificial Sequence: Synthetic oligonucleotide
gtggctactgccacctgaga

SEQ ID NO: 8591 - DNA, 20 bp, Artificial Sequence
  Description of Artificial Sequence: Synthetic oligonucleotide
tggctactgccacctgagac

SEQ ID NO: 8592 - DNA, 20 bp, Artificial Sequence
  Description of Artificial Sequence: Synthetic oligonucleotide
ggctactgccacctgagacc

SEQ ID NO: 8593 - DNA, 20 bp, Artificial Sequence
  Description of Artificial Sequence: Synthetic oligonucleotide
gctactgccacctgagacca

SEQ ID NO: 8594 - DNA, 20 bp, Artificial Sequence
  Description of Artificial Sequence: Synthetic oligonucleotide
ctactgccacctgagaccat

SEQ ID NO: 8595 - DNA, 20 bp, Artificial Sequence
  Description of Artificial Sequence: Synthetic oligonucleotide
tactgccacctgagaccata

SEQ ID NO: 8596 - DNA, 20 bp, Artificial Sequence
  Description of Artificial Sequence: Synthetic oligonucleotide
actgccacctgagaccataa

SEQ ID NO: 8597 - DNA, 20 bp, Artificial Sequence
  Description of Artificial Sequence: Synthetic oligonucleotide
ctgccacctgagaccataat

SEQ ID NO: 8598 - DNA, 20 bp, Artificial Sequence
  Description of Artificial Sequence: Synthetic oligonucleotide
tgccacctgagaccataatt

SEQ ID NO: 8599 - DNA, 20 bp, Artificial Sequence
  Description of Artificial Sequence: Synthetic oligonucleotide
gccacctgagaccataatta

SEQ ID NO: 8600 - DNA, 20 bp, Artificial Sequence
  Description of Artificial Sequence: Synthetic oligonucleotide
ccacctgagaccataattaa

SEQ ID NO: 8601 - DNA, 20 bp, Artificial Sequence
  Description of Artificial Sequence: Synthetic oligonucleotide
cacctgagaccataattaag

SEQ ID NO: 8602 - DNA, 20 bp, Artificial Sequence
  Description of Artificial Sequence: Synthetic oligonucleotide
acctgagaccataattaagg

SEQ ID NO: 8603 - DNA, 20 bp, Artificial Sequence
  Description of Artificial Sequence: Synthetic oligonucleotide
cctgagaccataattaaggg

SEQ ID NO: 8604 - DNA, 20 bp, Artificial Sequence
  Description of Artificial Sequence: Synthetic oligonucleotide
ctgagaccataattaaggga

SEQ ID NO: 8605 - DNA, 20 bp, Artificial Sequence
  Description of Artificial Sequence: Synthetic oligonucleotide
tgagaccataattaagggag

SEQ ID NO: 8606 - DNA, 20 bp, Artificial Sequence
  Description of Artificial Sequence: Synthetic oligonucleotide
gagaccataattaagggaga

SEQ ID NO: 8607 - DNA, 20 bp, Artificial Sequence
  Description of Artificial Sequence: Synthetic oligonucleotide
agaccataattaagggagat

SEQ ID NO: 8608 - DNA, 20 bp, Artificial Sequence
  Description of Artificial Sequence: Synthetic oligonucleotide
gaccataattaagggagata

SEQ ID NO: 8609 - DNA, 20 bp, Artificial Sequence
  Description of Artificial Sequence: Synthetic oligonucleotide
accataattaagggagatag

SEQ ID NO: 8610 - DNA, 20 bp, Artificial Sequence
  Description of Artificial Sequence: Synthetic oligonucleotide
ccataattaagggagataga

SEQ ID NO: 8611 - DNA, 20 bp, Artificial Sequence
  Description of Artificial Sequence: Synthetic oligonucleotide
cataattaagggagatagat

SEQ ID NO: 8612 - DNA, 20 bp, Artificial Sequence
  Description of Artificial Sequence: Synthetic oligonucleotide
ataattaagggagatagatt

SEQ ID NO: 8613 - DNA, 20 bp, Artificial Sequence
  Description of Artificial Sequence: Synthetic oligonucleotide
taattaagggagatagattt

SEQ ID NO: 8614 - DNA, 20 bp, Artificial Sequence
  Description of Artificial Sequence: Synthetic oligonucleotide
aattaagggagatagatttt

SEQ ID NO: 8615 - DNA, 20 bp, Artificial Sequence
  Description of Artificial Sequence: Synthetic oligonucleotide
attaagggagatagatttta

SEQ ID NO: 8616 - DNA, 20 bp, Artificial Sequence
  Description of Artificial Sequence: Synthetic oligonucleotide
ttaagggagatagattttat

SEQ ID NO: 8617 - DNA, 20 bp, Artificial Sequence
  Description of Artificial Sequence: Synthetic oligonucleotide
taagggagatagattttatt

SEQ ID NO: 8618 - DNA, 20 bp, Artificial Sequence
  Description of Artificial Sequence: Synthetic oligonucleotide
aagggagatagattttatta

SEQ ID NO: 8619 - DNA, 20 bp, Artificial Sequence
  Description of Artificial Sequence: Synthetic oligonucleotide
agggagatagattttattat

SEQ ID NO: 8620 - DNA, 20 bp, Artificial Sequence
  Description of Artificial Sequence: Synthetic oligonucleotide
gggagatagattttattatc

SEQ ID NO: 8621 - DNA, 20 bp, Artificial Sequence
  Description of Artificial Sequence: Synthetic oligonucleotide
ggagatagattttattatca

SEQ ID NO: 8622 - DNA, 20 bp, Artificial Sequence
  Description of Artificial Sequence: Synthetic oligonucleotide
gagatagattttattatcac

SEQ ID NO: 8623 - DNA, 20 bp, Artificial Sequence
  Description of Artificial Sequence: Synthetic oligonucleotide
agatagattttattatcaca

SEQ ID NO: 8624 - DNA, 20 bp, Artificial Sequence
  Description of Artificial Sequence: Synthetic oligonucleotide
gatagattttattatcacat

SEQ ID NO: 8625 - DNA, 20 bp, Artificial Sequence
  Description of Artificial Sequence: Synthetic oligonucleotide
atagattttattatcacata

SEQ ID NO: 8626 - DNA, 20 bp, Artificial Sequence
  Description of Artificial Sequence: Synthetic oligonucleotide
tagattttattatcacatat

SEQ ID NO: 8627 - DNA, 20 bp, Artificial Sequence
  Description of Artificial Sequence: Synthetic oligonucleotide
agattttattatcacatatt

SEQ ID NO: 8628 - DNA, 20 bp, Artificial Sequence
  Description of Artificial Sequence: Synthetic oligonucleotide
gattttattatcacatattt

SEQ ID NO: 8629 - DNA, 20 bp, Artificial Sequence
  Description of Artificial Sequence: Synthetic oligonucleotide
attttattatcacatatttt

SEQ ID NO: 8630 - DNA, 20 bp, Artificial Sequence
  Description of Artificial Sequence: Synthetic oligonucleotide
ttttattatcacatattttc

SEQ ID NO: 8631 - DNA, 20 bp, Artificial Sequence
  Description of Artificial Sequence: Synthetic oligonucleotide
tttattatcacatattttcc

SEQ ID NO: 8632 - DNA, 20 bp, Artificial Sequence
  Description of Artificial Sequence: Synthetic oligonucleotide
ttattatcacatattttccc

SEQ ID NO: 8633 - DNA, 20 bp, Artificial Sequence
  Description of Artificial Sequence: Synthetic oligonucleotide
tattatcacatattttcccc

SEQ ID NO: 8634 - DNA, 20 bp, Artificial Sequence
  Description of Artificial Sequence: Synthetic oligonucleotide
attatcacatattttcccct

SEQ ID NO: 8635 - DNA, 20 bp, Artificial Sequence
  Description of Artificial Sequence: Synthetic oligonucleotide
ttatcacatattttcccctt

SEQ ID NO: 8636 - DNA, 20 bp, Artificial Sequence
  Description of Artificial Sequence: Synthetic oligonucleotide
tatcacatattttccccttc

SEQ ID NO: 8637 - DNA, 20 bp, Artificial Sequence
  Description of Artificial Sequence: Synthetic oligonucleotide
atcacatattttccccttcc

SEQ ID NO: 8638 - DNA, 20 bp, Artificial Sequence
  Description of Artificial Sequence: Synthetic oligonucleotide
tcacatattttccccttcca

SEQ ID NO: 8639 - DNA, 20 bp, Artificial Sequence
  Description of Artificial Sequence: Synthetic oligonucleotide
cacatattttccccttccat

SEQ ID NO: 8640 - DNA, 20 bp, Artificial Sequence
  Description of Artificial Sequence: Synthetic oligonucleotide
acatattttccccttccatc

SEQ ID NO: 8641 - DNA, 20 bp, Artificial Sequence
  Description of Artificial Sequence: Synthetic oligonucleotide
catattttccccttccatcc

SEQ ID NO: 8642 - DNA, 20 bp, Artificial Sequence
  Description of Artificial Sequence: Synthetic oligonucleotide
atattttccccttccatcca

SEQ ID NO: 8643 - DNA, 20 bp, Artificial Sequence
  Description of Artificial Sequence: Synthetic oligonucleotide
tattttccccttccatccag

SEQ ID NO: 8644 - DNA, 20 bp, Artificial Sequence
  Description of Artificial Sequence: Synthetic oligonucleotide
attttccccttccatccagc

SEQ ID NO: 8645 - DNA, 20 bp, Artificial Sequence
  Description of Artificial Sequence: Synthetic oligonucleotide
ttttccccttccatccagct

SEQ ID NO: 8646 - DNA, 20 bp, Artificial Sequence
  Description of Artificial Sequence: Synthetic oligonucleotide
tttccccttccatccagcta

SEQ ID NO: 8647 - DNA, 20 bp, Artificial Sequence
  Description of Artificial Sequence: Synthetic oligonucleotide
ttccccttccatccagctag

SEQ ID NO: 8648 - DNA, 20 bp, Artificial Sequence
  Description of Artificial Sequence: Synthetic oligonucleotide
tccccttccatccagctagc

SEQ ID NO: 8649 - DNA, 20 bp, Artificial Sequence
  Description of Artificial Sequence: Synthetic oligonucleotide
ccccttccatccagctagca

SEQ ID NO: 8650 - DNA, 20 bp, Artificial Sequence
  Description of Artificial Sequence: Synthetic oligonucleotide
cccttccatccagctagcac

SEQ ID NO: 8651 - DNA, 20 bp, Artificial Sequence
  Description of Artificial Sequence: Synthetic oligonucleotide
ccttccatccagctagcacc

SEQ ID NO: 8652 - DNA, 20 bp, Artificial Sequence
  Description of Artificial Sequence: Synthetic oligonucleotide
cttccatccagctagcacct

SEQ ID NO: 8653 - DNA, 20 bp, Artificial Sequence
  Description of Artificial Sequence: Synthetic oligonucleotide
ttccatccagctagcacctc

SEQ ID NO: 8654 - DNA, 20 bp, Artificial Sequence
  Description of Artificial Sequence: Synthetic oligonucleotide
tccatccagctagcacctca

SEQ ID NO: 8655 - DNA, 20 bp, Artificial Sequence
  Description of Artificial Sequence: Synthetic oligonucleotide
ccatccagctagcacctcaa

SEQ ID NO: 8656 - DNA, 20 bp, Artificial Sequence
  Description of Artificial Sequence: Synthetic oligonucleotide
catccagctagcacctcaaa

SEQ ID NO: 8657 - DNA, 20 bp, Artificial Sequence
  Description of Artificial Sequence: Synthetic oligonucleotide
atccagctagcacctcaaaa

SEQ ID NO: 8658 - DNA, 20 bp, Artificial Sequence
  Description of Artificial Sequence: Synthetic oligonucleotide
tccagctagcacctcaaaac

SEQ ID NO: 8659 - DNA, 20 bp, Artificial Sequence
  Description of Artificial Sequence: Synthetic oligonucleotide
ccagctagcacctcaaaaca

SEQ ID NO: 8660 - DNA, 20 bp, Artificial Sequence
  Description of Artificial Sequence: Synthetic oligonucleotide
cagctagcacctcaaaacac

SEQ ID NO: 8661 - DNA, 20 bp, Artificial Sequence
  Description of Artificial Sequence: Synthetic oligonucleotide
agctagcacctcaaaacact

SEQ ID NO: 8662 - DNA, 20 bp, Artificial Sequence
  Description of Artificial Sequence: Synthetic oligonucleotide
gctagcacctcaaaacactc

SEQ ID NO: 8663 - DNA, 20 bp, Artificial Sequence
  Description of Artificial Sequence: Synthetic oligonucleotide
ctagcacctcaaaacactca

SEQ ID NO: 8664 - DNA, 20 bp, Artificial Sequence
  Description of Artificial Sequence: Synthetic oligonucleotide
tagcacctcaaaacactcag

SEQ ID NO: 8665 - DNA, 20 bp, Artificial Sequence
  Description of Artificial Sequence: Synthetic oligonucleotide
agcacctcaaaacactcaga

SEQ ID NO: 8666 - DNA, 20 bp, Artificial Sequence
  Description of Artificial Sequence: Synthetic oligonucleotide
gcacctcaaaacactcagaa

SEQ ID NO: 8667 - DNA, 20 bp, Artificial Sequence
  Description of Artificial Sequence: Synthetic oligonucleotide
cacctcaaaacactcagaag

SEQ ID NO: 8668 - DNA, 20 bp, Artificial Sequence
  Description of Artificial Sequence: Synthetic oligonucleotide
acctcaaaacactcagaaga

SEQ ID NO: 8669 - DNA, 20 bp, Artificial Sequence
  Description of Artificial Sequence: Synthetic oligonucleotide
cctcaaaacactcagaagaa

SEQ ID NO: 8670 - DNA, 20 bp, Artificial Sequence
  Description of Artificial Sequence: Synthetic oligonucleotide
ctcaaaacactcagaagaac

SEQ ID NO: 8671 - DNA, 20 bp, Artificial Sequence
  Description of Artificial Sequence: Synthetic oligonucleotide
tcaaaacactcagaagaacc

SEQ ID NO: 8672 - DNA, 20 bp, Artificial Sequence
  Description of Artificial Sequence: Synthetic oligonucleotide
caaaacactcagaagaacct

SEQ ID NO: 8673 - DNA, 20 bp, Artificial Sequence
  Description of Artificial Sequence: Synthetic oligonucleotide
aaaacactcagaagaacctt

SEQ ID NO: 8674 - DNA, 20 bp, Artificial Sequence
  Description of Artificial Sequence: Synthetic oligonucleotide
aaacactcagaagaaccttt

SEQ ID NO: 8675 - DNA, 20 bp, Artificial Sequence
  Description of Artificial Sequence: Synthetic oligonucleotide
aacactcagaagaacctttg

SEQ ID NO: 8676 - DNA, 20 bp, Artificial Sequence
  Description of Artificial Sequence: Synthetic oligonucleotide
acactcagaagaacctttga

SEQ ID NO: 8677 - DNA, 20 bp, Artificial Sequence
  Description of Artificial Sequence: Synthetic oligonucleotide
cactcagaagaacctttgag

SEQ ID NO: 8678 - DNA, 20 bp, Artificial Sequence
  Description of Artificial Sequence: Synthetic oligonucleotide
actcagaagaacctttgagg

SEQ ID NO: 8679 - DNA, 20 bp, Artificial Sequence
  Description of Artificial Sequence: Synthetic oligonucleotide
ctcagaagaacctttgaggc

SEQ ID NO: 8680 - DNA, 20 bp, Artificial Sequence
  Description of Artificial Sequence: Synthetic oligonucleotide
tcagaagaacctttgaggcc

SEQ ID NO: 8681 - DNA, 20 bp, Artificial Sequence
  Description of Artificial Sequence: Synthetic oligonucleotide
cagaagaacctttgaggcct

SEQ ID NO: 8682 - DNA, 20 bp, Artificial Sequence
  Description of Artificial Sequence: Synthetic oligonucleotide
agaagaacctttgaggcctt

SEQ ID NO: 8683 - DNA, 20 bp, Artificial Sequence
  Description of Artificial Sequence: Synthetic oligonucleotide
gaagaacctttgaggccttc

SEQ ID NO: 8684 - DNA, 20 bp, Artificial Sequence
  Description of Artificial Sequence: Synthetic oligonucleotide
aagaacctttgaggccttcc

SEQ ID NO: 8685 - DNA, 20 bp, Artificial Sequence
  Description of Artificial Sequence: Synthetic oligonucleotide
agaacctttgaggccttcct

SEQ ID NO: 8686 - DNA, 20 bp, Artificial Sequence
  Description of Artificial Sequence: Synthetic oligonucleotide
gaacctttgaggccttcctc

SEQ ID NO: 8687 - DNA, 20 bp, Artificial Sequence
  Description of Artificial Sequence: Synthetic oligonucleotide
aacctttgaggccttcctcc

SEQ ID NO: 8688 - DNA, 20 bp, Artificial Sequence
  Description of Artificial Sequence: Synthetic oligonucleotide
acctttgaggccttcctccc

SEQ ID NO: 8689 - DNA, 20 bp, Artificial Sequence
  Description of Artificial Sequence: Synthetic oligonucleotide
cctttgaggccttcctccca

SEQ ID NO: 8690 - DNA, 20 bp, Artificial Sequence
  Description of Artificial Sequence: Synthetic oligonucleotide
ctttgaggccttcctcccag

SEQ ID NO: 8691 - DNA, 20 bp, Artificial Sequence
  Description of Artificial Sequence: Synthetic oligonucleotide
tttgaggccttcctcccaga

SEQ ID NO: 8692 - DNA, 20 bp, Artificial Sequence
  Description of Artificial Sequence: Synthetic oligonucleotide
ttgaggccttcctcccagaa

SEQ ID NO: 8693 - DNA, 20 bp, Artificial Sequence
  Description of Artificial Sequence: Synthetic oligonucleotide
tgaggccttcctcccagaag

SEQ ID NO: 8694 - DNA, 20 bp, Artificial Sequence
  Description of Artificial Sequence: Synthetic oligonucleotide
gaggccttcctcccagaagt

SEQ ID NO: 8695 - DNA, 20 bp, Artificial Sequence
  Description of Artificial Sequence: Synthetic oligonucleotide
aggccttcctcccagaagtt

SEQ ID NO: 8696 - DNA, 20 bp, Artificial Sequence
  Description of Artificial Sequence: Synthetic oligonucleotide
ggccttcctcccagaagttt

SEQ ID NO: 8697 - DNA, 20 bp, Artificial Sequence
  Description of Artificial Sequence: Synthetic oligonucleotide
gccttcctcccagaagtttt

SEQ ID NO: 8698 - DNA, 20 bp, Artificial Sequence
  Description of Artificial Sequence: Synthetic oligonucleotide
ccttcctcccagaagttttg

SEQ ID NO: 8699 - DNA, 20 bp, Artificial Sequence
  Description of Artificial Sequence: Synthetic oligonucleotide
cttcctcccagaagttttgt

SEQ ID NO: 8700 - DNA, 20 bp, Artificial Sequence
  Description of Artificial Sequence: Synthetic oligonucleotide
ttcctcccagaagttttgtt

SEQ ID NO: 8701 - DNA, 20 bp, Artificial Sequence
  Description of Artificial Sequence: Synthetic oligonucleotide
tcctcccagaagttttgtta

SEQ ID NO: 8702 - DNA, 20 bp, Artificial Sequence
  Description of Artificial Sequence: Synthetic oligonucleotide
cctcccagaagttttgttaa

SEQ ID NO: 8703 - DNA, 20 bp, Artificial Sequence
  Description of Artificial Sequence: Synthetic oligonucleotide
ctcccagaagttttgttaaa

SEQ ID NO: 8704 - DNA, 20 bp, Artificial Sequence
  Description of Artificial Sequence: Synthetic oligonucleotide
tcccagaagttttgttaaaa

SEQ ID NO: 8705 - DNA, 20 bp, Artificial Sequence
  Description of Artificial Sequence: Synthetic oligonucleotide
cccagaagttttgttaaaac

SEQ ID NO: 8706 - DNA, 20 bp, Artificial Sequence
  Description of Artificial Sequence: Synthetic oligonucleotide
ccagaagttttgttaaaaca

SEQ ID NO: 8707 - DNA, 20 bp, Artificial Sequence
  Description of Artificial Sequence: Synthetic oligonucleotide
cagaagttttgttaaaacaa

SEQ ID NO: 8708 - DNA, 20 bp, Artificial Sequence
  Description of Artificial Sequence: Synthetic oligonucleotide
agaagttttgttaaaacaat

SEQ ID NO: 8709 - DNA, 20 bp, Artificial Sequence
  Description of Artificial Sequence: Synthetic oligonucleotide
gaagttttgttaaaacaatg

SEQ ID NO: 8710 - DNA, 20 bp, Artificial Sequence
  Description of Artificial Sequence: Synthetic oligonucleotide
aagttttgttaaaacaatga

SEQ ID NO: 8711 - DNA, 20 bp, Artificial Sequence
  Description of Artificial Sequence: Synthetic oligonucleotide
agttttgttaaaacaatgaa

SEQ ID NO: 8712 - DNA, 20 bp, Artificial Sequence
  Description of Artificial Sequence: Synthetic oligonucleotide
gttttgttaaaacaatgaaa

SEQ ID NO: 8713 - DNA, 20 bp, Artificial Sequence
  Description of Artificial Sequence: Synthetic oligonucleotide
ttttgttaaaacaatgaaat

SEQ ID NO: 8714 - DNA, 20 bp, Artificial Sequence
  Description of Artificial Sequence: Synthetic oligonucleotide
tttgttaaaacaatgaaatg

SEQ ID NO: 8715 - DNA, 20 bp, Artificial Sequence
  Description of Artificial Sequence: Synthetic oligonucleotide
ttgttaaaacaatgaaatga

SEQ ID NO: 8716 - DNA, 20 bp, Artificial Sequence
  Description of Artificial Sequence: Synthetic oligonucleotide
tgttaaaacaatgaaatgag

SEQ ID NO: 8717 - DNA, 20 bp, Artificial Sequence
  Description of Artificial Sequence: Synthetic oligonucleotide
gttaaaacaatgaaatgaga

SEQ ID NO: 8718 - DNA, 20 bp, Artificial Sequence
  Description of Artificial Sequence: Synthetic oligonucleotide
ttaaaacaatgaaatgagag

SEQ ID NO: 8719 - DNA, 20 bp, Artificial Sequence
  Description of Artificial Sequence: Synthetic oligonucleotide
taaaacaatgaaatgagagc

SEQ ID NO: 8720 - DNA, 20 bp, Artificial Sequence
  Description of Artificial Sequence: Synthetic oligonucleotide
aaaacaatgaaatgagagca

SEQ ID NO: 8721 - DNA, 20 bp, Artificial Sequence
  Description of Artificial Sequence: Synthetic oligonucleotide
aaacaatgaaatgagagcat

SEQ ID NO: 8722 - DNA, 20 bp, Artificial Sequence
  Description of Artificial Sequence: Synthetic oligonucleotide
aacaatgaaatgagagcatc

SEQ ID NO: 8723 - DNA, 20 bp, Artificial Sequence
  Description of Artificial Sequence: Synthetic oligonucleotide
acaatgaaatgagagcatca

SEQ ID NO: 8724 - DNA, 20 bp, Artificial Sequence
  Description of Artificial Sequence: Synthetic oligonucleotide
caatgaaatgagagcatcag

SEQ ID NO: 8725 - DNA, 20 bp, Artificial Sequence
  Description of Artificial Sequence: Synthetic oligonucleotide
aatgaaatgagagcatcaga

SEQ ID NO: 8726 - DNA, 20 bp, Artificial Sequence
  Description of Artificial Sequence: Synthetic oligonucleotide
atgaaatgagagcatcagac

SEQ ID NO: 8727 - DNA, 20 bp, Artificial Sequence
  Description of Artificial Sequence: Synthetic oligonucleotide
tgaaatgagagcatcagact

SEQ ID NO: 8728 - DNA, 20 bp, Artificial Sequence
  Description of Artificial Sequence: Synthetic oligonucleotide
gaaatgagagcatcagactg

SEQ ID NO: 8729 - DNA, 20 bp, Artificial Sequence
  Description of Artificial Sequence: Synthetic oligonucleotide
aaatgagagcatcagactgg

SEQ ID NO: 8730 - DNA, 20 bp, Artificial Sequence
  Description of Artificial Sequence: Synthetic oligonucleotide
aatgagagcatcagactggc

SEQ ID NO: 8731 - DNA, 20 bp, Artificial Sequence
  Description of Artificial Sequence: Synthetic oligonucleotide
atgagagcatcagactggcc

SEQ ID NO: 8732 - DNA, 20 bp, Artificial Sequence
  Description of Artificial Sequence: Synthetic oligonucleotide
tgagagcatcagactggcca

SEQ ID NO: 8733 - DNA, 20 bp, Artificial Sequence
  Description of Artificial Sequence: Synthetic oligonucleotide
gagagcatcagactggccag

SEQ ID NO: 8734 - DNA, 20 bp, Artificial Sequence
  Description of Artificial Sequence: Synthetic oligonucleotide
agagcatcagactggccagt

SEQ ID NO: 8735 - DNA, 20 bp, Artificial Sequence
  Description of Artificial Sequence: Synthetic oligonucleotide
gagcatcagactggccagtt

SEQ ID NO: 8736 - DNA, 20 bp, Artificial Sequence
  Description of Artificial Sequence: Synthetic oligonucleotide
agcatcagactggccagttt

SEQ ID NO: 8737 - DNA, 20 bp, Artificial Sequence
  Description of Artificial Sequence: Synthetic oligonucleotide
gcatcagactggccagtttt

SEQ ID NO: 8738 - DNA, 20 bp, Artificial Sequence
  Description of Artificial Sequence: Synthetic oligonucleotide
catcagactggccagttttt

SEQ ID NO: 8739 - DNA, 20 bp, Artificial Sequence
  Description of Artificial Sequence: Synthetic oligonucleotide
atcagactggccagtttttt

SEQ ID NO: 8740 - DNA, 20 bp, Artificial Sequence
  Description of Artificial Sequence: Synthetic oligonucleotide
tcagactggccagttttttt

SEQ ID NO: 8741 - DNA, 20 bp, Artificial Sequence
  Description of Artificial Sequence: Synthetic oligonucleotide
cagactggccagttttttta

SEQ ID NO: 8742 - DNA, 20 bp, Artificial Sequence
  Description of Artificial Sequence: Synthetic oligonucleotide
agactggccagtttttttac

SEQ ID NO: 8743 - DNA, 20 bp, Artificial Sequence
  Description of Artificial Sequence: Synthetic oligonucleotide
gactggccagtttttttact

SEQ ID NO: 8744 - DNA, 20 bp, Artificial Sequence
  Description of Artificial Sequence: Synthetic oligonucleotide
actggccagtttttttactc

SEQ ID NO: 8745 - DNA, 20 bp, Artificial Sequence
  Description of Artificial Sequence: Synthetic oligonucleotide
ctggccagtttttttactct

SEQ ID NO: 8746 - DNA, 20 bp, Artificial Sequence
  Description of Artificial Sequence: Synthetic oligonucleotide
tggccagtttttttactcta

SEQ ID NO: 8747 - DNA, 20 bp, Artificial Sequence
  Description of Artificial Sequence: Synthetic oligonucleotide
ggccagtttttttactctag

SEQ ID NO: 8748 - DNA, 20 bp, Artificial Sequence
  Description of Artificial Sequence: Synthetic oligonucleotide
gccagtttttttactctagg

SEQ ID NO: 8749 - DNA, 20 bp, Artificial Sequence
  Description of Artificial Sequence: Synthetic oligonucleotide
ccagtttttttactctaggg

SEQ ID NO: 8750 - DNA, 20 bp, Artificial Sequence
  Description of Artificial Sequence: Synthetic oligonucleotide
cagtttttttactctagggc

SEQ ID NO: 8751 - DNA, 20 bp, Artificial Sequence
  Description of Artificial Sequence: Synthetic oligonucleotide
agtttttttactctagggcc

SEQ ID NO: 8752 - DNA, 20 bp, Artificial Sequence
  Description of Artificial Sequence: Synthetic oligonucleotide
gtttttttactctagggcca

SEQ ID NO: 8753 - DNA, 20 bp, Artificial Sequence
  Description of Artificial Sequence: Synthetic oligonucleotide
tttttttactctagggccat

SEQ ID NO: 8754 - DNA, 20 bp, Artificial Sequence
  Description of Artificial Sequence: Synthetic oligonucleotide
ttttttactctagggccatg

SEQ ID NO: 8755 - DNA, 20 bp, Artificial Sequence
  Description of Artificial Sequence: Synthetic oligonucleotide
tttttactctagggccatgg

SEQ ID NO: 8756 - DNA, 20 bp, Artificial Sequence
  Description of Artificial Sequence: Synthetic oligonucleotide
ttttactctagggccatgga

SEQ ID NO: 8757 - DNA, 20 bp, Artificial Sequence
  Description of Artificial Sequence: Synthetic oligonucleotide
tttactctagggccatggag

SEQ ID NO: 8758 - DNA, 20 bp, Artificial Sequence
  Description of Artificial Sequence: Synthetic oligonucleotide
ttactctagggccatggagc

SEQ ID NO: 8759 - DNA, 20 bp, Artificial Sequence
  Description of Artificial Sequence: Synthetic oligonucleotide
tactctagggccatggagct

SEQ ID NO: 8760 - DNA, 20 bp, Artificial Sequence
  Description of Artificial Sequence: Synthetic oligonucleotide
actctagggccatggagctg

SEQ ID NO: 8761 - DNA, 20 bp, Artificial Sequence
  Description of Artificial Sequence: Synthetic oligonucleotide
ctctagggccatggagctgc

SEQ ID NO: 8762 - DNA, 20 bp, Artificial Sequence
  Description of Artificial Sequence: Synthetic oligonucleotide
tctagggccatggagctgct

SEQ ID NO: 8763 - DNA, 20 bp, Artificial Sequence
  Description of Artificial Sequence: Synthetic oligonucleotide
ctagggccatggagctgcta

SEQ ID NO: 8764 - DNA, 20 bp, Artificial Sequence
  Description of Artificial Sequence: Synthetic oligonucleotide
tagggccatggagctgctac

SEQ ID NO: 8765 - DNA, 20 bp, Artificial Sequence
  Description of Artificial Sequence: Synthetic oligonucleotide
agggccatggagctgctact

SEQ ID NO: 8766 - DNA, 20 bp, Artificial Sequence
  Description of Artificial Sequence: Synthetic oligonucleotide
gggccatggagctgctactt

SEQ ID NO: 8767 - DNA, 20 bp, Artificial Sequence
  Description of Artificial Sequence: Synthetic oligonucleotide
ggccatggagctgctacttt

SEQ ID NO: 8768 - DNA, 20 bp, Artificial Sequence
  Description of Artificial Sequence: Synthetic oligonucleotide
gccatggagctgctacttta

SEQ ID NO: 8769 - DNA, 20 bp, Artificial Sequence
  Description of Artificial Sequence: Synthetic oligonucleotide
ccatggagctgctactttat

SEQ ID NO: 8770 - DNA, 20 bp, Artificial Sequence
  Description of Artificial Sequence: Synthetic oligonucleotide
catggagctgctactttatg

SEQ ID NO: 8771 - DNA, 20 bp, Artificial Sequence
  Description of Artificial Sequence: Synthetic oligonucleotide
atggagctgctactttatgc

SEQ ID NO: 8772 - DNA, 20 bp, Artificial Sequence
  Description of Artificial Sequence: Synthetic oligonucleotide
tggagctgctactttatgca

SEQ ID NO: 8773 - DNA, 20 bp, Artificial Sequence
  Description of Artificial Sequence: Synthetic oligonucleotide
ggagctgctactttatgcag

SEQ ID NO: 8774 - DNA, 20 bp, Artificial Sequence
  Description of Artificial Sequence: Synthetic oligonucleotide
gagctgctactttatgcagg

SEQ ID NO: 8775 - DNA, 20 bp, Artificial Sequence
  Description of Artificial Sequence: Synthetic oligonucleotide
agctgctactttatgcagga

SEQ ID NO: 8776 - DNA, 20 bp, Artificial Sequence
  Description of Artificial Sequence: Synthetic oligonucleotide
gctgctactttatgcaggat

SEQ ID NO: 8777 - DNA, 20 bp, Artificial Sequence
  Description of Artificial Sequence: Synthetic oligonucleotide
ctgctactttatgcaggatt

SEQ ID NO: 8778 - DNA, 20 bp, Artificial Sequence
  Description of Artificial Sequence: Synthetic oligonucleotide
tgctactttatgcaggattt

SEQ ID NO: 8779 - DNA, 20 bp, Artificial Sequence
  Description of Artificial Sequence: Synthetic oligonucleotide
gctactttatgcaggattta

SEQ ID NO: 8780 - DNA, 20 bp, Artificial Sequence
  Description of Artificial Sequence: Synthetic oligonucleotide
ctactttatgcaggatttaa

SEQ ID NO: 8781 - DNA, 20 bp, Artificial Sequence
  Description of Artificial Sequence: Synthetic oligonucleotide
tactttatgcaggatttaag

SEQ ID NO: 8782 - DNA, 20 bp, Artificial Sequence
  Description of Artificial Sequence: Synthetic oligonucleotide
actttatgcaggatttaagc

SEQ ID NO: 8783 - DNA, 20 bp, Artificial Sequence
  Description of Artificial Sequence: Synthetic oligonucleotide
ctttatgcaggatttaagct

SEQ ID NO: 8784 - DNA, 20 bp, Artificial Sequence
  Description of Artificial Sequence: Synthetic oligonucleotide
tttatgcaggatttaagctc

SEQ ID NO: 8785 - DNA, 20 bp, Artificial Sequence
  Description of Artificial Sequence: Synthetic oligonucleotide
ttatgcaggatttaagctct

SEQ ID NO: 8786 - DNA, 20 bp, Artificial Sequence
  Description of Artificial Sequence: Synthetic oligonucleotide
tatgcaggatttaagctctg

SEQ ID NO: 8787 - DNA, 20 bp, Artificial Sequence
  Description of Artificial Sequence: Synthetic oligonucleotide
atgcaggatttaagctctgt

SEQ ID NO: 8788 - DNA, 20 bp, Artificial Sequence
  Description of Artificial Sequence: Synthetic oligonucleotide
tgcaggatttaagctctgta

SEQ ID NO: 8789 - DNA, 20 bp, Artificial Sequence
  Description of Artificial Sequence: Synthetic oligonucleotide
gcaggatttaagctctgtat

SEQ ID NO: 8790 - DNA, 20 bp, Artificial Sequence
  Description of Artificial Sequence: Synthetic oligonucleotide
caggatttaagctctgtatt

SEQ ID NO: 8791 - DNA, 20 bp, Artificial Sequence
  Description of Artificial Sequence: Synthetic oligonucleotide
aggatttaagctctgtattc

SEQ ID NO: 8792 - DNA, 20 bp, Artificial Sequence
  Description of Artificial Sequence: Synthetic oligonucleotide
ggatttaagctctgtattct

SEQ ID NO: 8793 - DNA, 20 bp, Artificial Sequence
  Description of Artificial Sequence: Synthetic oligonucleotide
gatttaagctctgtattcta

SEQ ID NO: 8794 - DNA, 20 bp, Artificial Sequence
  Description of Artificial Sequence: Synthetic oligonucleotide
atttaagctctgtattctaa

SEQ ID NO: 8795 - DNA, 20 bp, Artificial Sequence
  Description of Artificial Sequence: Synthetic oligonucleotide
tttaagctctgtattctaaa

SEQ ID NO: 8796 - DNA, 20 bp, Artificial Sequence
  Description of Artificial Sequence: Synthetic oligonucleotide
ttaagctctgtattctaaat

SEQ ID NO: 8797 - DNA, 20 bp, Artificial Sequence
  Description of Artificial Sequence: Synthetic oligonucleotide
taagctctgtattctaaata

SEQ ID NO: 8798 - DNA, 20 bp, Artificial Sequence
  Description of Artificial Sequence: Synthetic oligonucleotide
aagctctgtattctaaatat

SEQ ID NO: 8799 - DNA, 20 bp, Artificial Sequence
  Description of Artificial Sequence: Synthetic oligonucleotide
agctctgtattctaaatatc

SEQ ID NO: 8800 - DNA, 20 bp, Artificial Sequence
  Description of Artificial Sequence: Synthetic oligonucleotide
gctctgtattctaaatatca

SEQ ID NO: 8801 - DNA, 20 bp, Artificial Sequence
  Description of Artificial Sequence: Synthetic oligonucleotide
ctctgtattctaaatatcaa

SEQ ID NO: 8802 - DNA, 20 bp, Artificial Sequence
  Description of Artificial Sequence: Synthetic oligonucleotide
tctgtattctaaatatcaaa

SEQ ID NO: 8803 - DNA, 20 bp, Artificial Sequence
  Description of Artificial Sequence: Synthetic oligonucleotide
ctgtattctaaatatcaaag

SEQ ID NO: 8804 - DNA, 20 bp, Artificial Sequence
  Description of Artificial Sequence: Synthetic oligonucleotide
tgtattctaaatatcaaaga

SEQ ID NO: 8805 - DNA, 20 bp, Artificial Sequence
  Description of Artificial Sequence: Synthetic oligonucleotide
gtattctaaatatcaaagag

SEQ ID NO: 8806 - DNA, 20 bp, Artificial Sequence
  Description of Artificial Sequence: Synthetic oligonucleotide
tattctaaatatcaaagagc

SEQ ID NO: 8807 - DNA, 20 bp, Artificial Sequence
  Description of Artificial Sequence: Synthetic oligonucleotide
attctaaatatcaaagagca

SEQ ID NO: 8808 - DNA, 20 bp, Artificial Sequence
  Description of Artificial Sequence: Synthetic oligonucleotide
ttctaaatatcaaagagcat

SEQ ID NO: 8809 - DNA, 20 bp, Artificial Sequence
  Description of Artificial Sequence: Synthetic oligonucleotide
tctaaatatcaaagagcata

SEQ ID NO: 8810 - DNA, 20 bp, Artificial Sequence
  Description of Artificial Sequence: Synthetic oligonucleotide
ctaaatatcaaagagcatag

SEQ ID NO: 8811 - DNA, 20 bp, Artificial Sequence
  Description of Artificial Sequence: Synthetic oligonucleotide
taaatatcaaagagcatagt

SEQ ID NO: 8812 - DNA, 20 bp, Artificial Sequence
  Description of Artificial Sequence: Synthetic oligonucleotide
aaatatcaaagagcatagtg

SEQ ID NO: 8813 - DNA, 20 bp, Artificial Sequence
  Description of Artificial Sequence: Synthetic oligonucleotide
aatatcaaagagcatagtgg

SEQ ID NO: 8814 - DNA, 20 bp, Artificial Sequence
  Description of Artificial Sequence: Synthetic oligonucleotide
atatcaaagagcatagtgga

SEQ ID NO: 8815 - DNA, 20 bp, Artificial Sequence
  Description of Artificial Sequence: Synthetic oligonucleotide
tatcaaagagcatagtggaa

SEQ ID NO: 8816 - DNA, 20 bp, Artificial Sequence
  Description of Artificial Sequence: Synthetic oligonucleotide
atcaaagagcatagtggaag

SEQ ID NO: 8817 - DNA, 20 bp, Artificial Sequence
  Description of Artificial Sequence: Synthetic oligonucleotide
tcaaagagcatagtggaaga

SEQ ID NO: 8818 - DNA, 20 bp, Artificial Sequence
  Description of Artificial Sequence: Synthetic oligonucleotide
caaagagcatagtggaagag

SEQ ID NO: 8819 - DNA, 20 bp, Artificial Sequence
  Description of Artificial Sequence: Synthetic oligonucleotide
aaagagcatagtggaagaga

SEQ ID NO: 8820 - DNA, 20 bp, Artificial Sequence
  Description of Artificial Sequence: Synthetic oligonucleotide
aagagcatagtggaagagac

SEQ ID NO: 8821 - DNA, 20 bp, Artificial Sequence
  Description of Artificial Sequence: Synthetic oligonucleotide
agagcatagtggaagagaca

SEQ ID NO: 8822 - DNA, 20 bp, Artificial Sequence
  Description of Artificial Sequence: Synthetic oligonucleotide
gagcatagtggaagagacag

SEQ ID NO: 8823 - DNA, 20 bp, Artificial Sequence
  Description of Artificial Sequence: Synthetic oligonucleotide
agcatagtggaagagacagc

SEQ ID NO: 8824 - DNA, 20 bp, Artificial Sequence
  Description of Artificial Sequence: Synthetic oligonucleotide
gcatagtggaagagacagcc

SEQ ID NO: 8825 - DNA, 20 bp, Artificial Sequence
  Description of Artificial Sequence: Synthetic oligonucleotide
catagtggaagagacagcct

SEQ ID NO: 8826 - DNA, 20 bp, Artificial Sequence
  Description of Artificial Sequence: Synthetic oligonucleotide
atagtggaagagacagcctt

SEQ ID NO: 8827 - DNA, 20 bp, Artificial Sequence
  Description of Artificial Sequence: Synthetic oligonucleotide
tagtggaagagacagccttt

SEQ ID NO: 8828 - DNA, 20 bp, Artificial Sequence
  Description of Artificial Sequence: Synthetic oligonucleotide
agtggaagagacagcctttt

SEQ ID NO: 8829 - DNA, 20 bp, Artificial Sequence
  Description of Artificial Sequence: Synthetic oligonucleotide
gtggaagagacagccttttc

SEQ ID NO: 8830 - DNA, 20 bp, Artificial Sequence
  Description of Artificial Sequence: Synthetic oligonucleotide
tggaagagacagccttttct

SEQ ID NO: 8831 - DNA, 20 bp, Artificial Sequence
  Description of Artificial Sequence: Synthetic oligonucleotide
ggaagagacagccttttctg

SEQ ID NO: 8832 - DNA, 20 bp, Artificial Sequence
  Description of Artificial Sequence: Synthetic oligonucleotide
gaagagacagccttttctga

SEQ ID NO: 8833 - DNA, 20 bp, Artificial Sequence
  Description of Artificial Sequence: Synthetic oligonucleotide
aagagacagccttttctgat

SEQ ID NO: 8834 - DNA, 20 bp, Artificial Sequence
  Description of Artificial Sequence: Synthetic oligonucleotide
agagacagccttttctgata

SEQ ID NO: 8835 - DNA, 20 bp, Artificial Sequence
  Description of Artificial Sequence: Synthetic oligonucleotide
gagacagccttttctgatag

SEQ ID NO: 8836 - DNA, 20 bp, Artificial Sequence
  Description of Artificial Sequence: Synthetic oligonucleotide
agacagccttttctgatagg

SEQ ID NO: 8837 - DNA, 20 bp, Artificial Sequence
  Description of Artificial Sequence: Synthetic oligonucleotide
gacagccttttctgatagga

SEQ ID NO: 8838 - DNA, 20 bp, Artificial Sequence
  Description of Artificial Sequence: Synthetic oligonucleotide
acagccttttctgataggat

SEQ ID NO: 8839 - DNA, 20 bp, Artificial Sequence
  Description of Artificial Sequence: Synthetic oligonucleotide
cagccttttctgataggatt

SEQ ID NO: 8840 - DNA, 20 bp, Artificial Sequence
  Description of Artificial Sequence: Synthetic oligonucleotide
agccttttctgataggattc

SEQ ID NO: 8841 - DNA, 20 bp, Artificial Sequence
  Description of Artificial Sequence: Synthetic oligonucleotide
gccttttctgataggattca

SEQ ID NO: 8842 - DNA, 20 bp, Artificial Sequence
  Description of Artificial Sequence: Synthetic oligonucleotide
ccttttctgataggattcag

SEQ ID NO: 8843 - DNA, 20 bp, Artificial Sequence
  Description of Artificial Sequence: Synthetic oligonucleotide
cttttctgataggattcaga

SEQ ID NO: 8844 - DNA, 20 bp, Artificial Sequence
  Description of Artificial Sequence: Synthetic oligonucleotide
ttttctgataggattcagag

SEQ ID NO: 8845 - DNA, 20 bp, Artificial Sequence
  Description of Artificial Sequence: Synthetic oligonucleotide
tttctgataggattcagaga

SEQ ID NO: 8846 - DNA, 20 bp, Artificial Sequence
  Description of Artificial Sequence: Synthetic oligonucleotide
ttctgataggattcagagac

SEQ ID NO: 8847 - DNA, 20 bp, Artificial Sequence
  Description of Artificial Sequence: Synthetic oligonucleotide
tctgataggattcagagact

SEQ ID NO: 8848 - DNA, 20 bp, Artificial Sequence
  Description of Artificial Sequence: Synthetic oligonucleotide
ctgataggattcagagactg

SEQ ID NO: 8849 - DNA, 20 bp, Artificial Sequence
  Description of Artificial Sequence: Synthetic oligonucleotide
tgataggattcagagactgc

SEQ ID NO: 8850 - DNA, 20 bp, Artificial Sequence
  Description of Artificial Sequence: Synthetic oligonucleotide
gataggattcagagactgcg

SEQ ID NO: 8851 - DNA, 20 bp, Artificial Sequence
  Description of Artificial Sequence: Synthetic oligonucleotide
ataggattcagagactgcgg

SEQ ID NO: 8852 - DNA, 20 bp, Artificial Sequence
  Description of Artificial Sequence: Synthetic oligonucleotide
taggattcagagactgcggc

SEQ ID NO: 8853 - DNA, 20 bp, Artificial Sequence
  Description of Artificial Sequence: Synthetic oligonucleotide
aggattcagagactgcggcc

SEQ ID NO: 8854 - DNA, 20 bp, Artificial Sequence
  Description of Artificial Sequence: Synthetic oligonucleotide
ggattcagagactgcggccc

SEQ ID NO: 8855 - DNA, 20 bp, Artificial Sequence
  Description of Artificial Sequence: Synthetic oligonucleotide
gattcagagactgcggccct

SEQ ID NO: 8856 - DNA, 20 bp, Artificial Sequence
  Description of Artificial Sequence: Synthetic oligonucleotide
attcagagactgcggccctt

SEQ ID NO: 8857 - DNA, 20 bp, Artificial Sequence
  Description of Artificial Sequence: Synthetic oligonucleotide
ttcagagactgcggccctta

SEQ ID NO: 8858 - DNA, 20 bp, Artificial Sequence
  Description of Artificial Sequence: Synthetic oligonucleotide
tcagagactgcggcccttac

SEQ ID NO: 8859 - DNA, 20 bp, Artificial Sequence
  Description of Artificial Sequence: Synthetic oligonucleotide
cagagactgcggcccttact

SEQ ID NO: 8860 - DNA, 20 bp, Artificial Sequence
  Description of Artificial Sequence: Synthetic oligonucleotide
agagactgcggcccttacta

SEQ ID NO: 8861 - DNA, 20 bp, Artificial Sequence
  Description of Artificial Sequence: Synthetic oligonucleotide
gagactgcggcccttactat

SEQ ID NO: 8862 - DNA, 20 bp, Artificial Sequence
  Description of Artificial Sequence: Synthetic oligonucleotide
agactgcggcccttactatc

SEQ ID NO: 8863 - DNA, 20 bp, Artificial Sequence
  Description of Artificial Sequence: Synthetic oligonucleotide
gactgcggcccttactatcc

SEQ ID NO: 8864 - DNA, 20 bp, Artificial Sequence
  Description of Artificial Sequence: Synthetic oligonucleotide
actgcggcccttactatcca

SEQ ID NO: 8865 - DNA, 20 bp, Artificial Sequence
  Description of Artificial Sequence: Synthetic oligonucleotide
ctgcggcccttactatccaa

SEQ ID NO: 8866 - DNA, 20 bp, Artificial Sequence
  Description of Artificial Sequence: Synthetic oligonucleotide
tgcggcccttactatccaag

SEQ ID NO: 8867 - DNA, 20 bp, Artificial Sequence
  Description of Artificial Sequence: Synthetic oligonucleotide
gcggcccttactatccaaga

SEQ ID NO: 8868 - DNA, 20 bp, Artificial Sequence
  Description of Artificial Sequence: Synthetic oligonucleotide
cggcccttactatccaagag

SEQ ID NO: 8869 - DNA, 20 bp, Artificial Sequence
  Description of Artificial Sequence: Synthetic oligonucleotide
ggcccttactatccaagaga

SEQ ID NO: 8870 - DNA, 20 bp, Artificial Sequence
  Description of Artificial Sequence: Synthetic oligonucleotide
gcccttactatccaagagaa

SEQ ID NO: 8871 - DNA, 20 bp, Artificial Sequence
  Description of Artificial Sequence: Synthetic oligonucleotide
cccttactatccaagagaag

SEQ ID NO: 8872 - DNA, 20 bp, Artificial Sequence
  Description of Artificial Sequence: Synthetic oligonucleotide
ccttactatccaagagaagc

SEQ ID NO: 8873 - DNA, 20 bp, Artificial Sequence
  Description of Artificial Sequence: Synthetic oligonucleotide
cttactatccaagagaagct

SEQ ID NO: 8874 - DNA, 20 bp, Artificial Sequence
  Description of Artificial Sequence: Synthetic oligonucleotide
ttactatccaagagaagctt

SEQ ID NO: 8875 - DNA, 20 bp, Artificial Sequence
  Description of Artificial Sequence: Synthetic oligonucleotide
tactatccaagagaagcttc

SEQ ID NO: 8876 - DNA, 20 bp, Artificial Sequence
  Description of Artificial Sequence: Synthetic oligonucleotide
actatccaagagaagcttcc

SEQ ID NO: 8877 - DNA, 20 bp, Artificial Sequence
  Description of Artificial Sequence: Synthetic oligonucleotide
ctatccaagagaagcttcct

SEQ ID NO: 8878 - DNA, 20 bp, Artificial Sequence
  Description of Artificial Sequence: Synthetic oligonucleotide
tatccaagagaagcttcctg

SEQ ID NO: 8879 - DNA, 20 bp, Artificial Sequence
  Description of Artificial Sequence: Synthetic oligonucleotide
atccaagagaagcttcctgc

SEQ ID NO: 8880 - DNA, 20 bp, Artificial Sequence
  Description of Artificial Sequence: Synthetic oligonucleotide
tccaagagaagcttcctgcc

SEQ ID NO: 8881 - DNA, 20 bp, Artificial Sequence
  Description of Artificial Sequence: Synthetic oligonucleotide
ccaagagaagcttcctgcct

SEQ ID NO: 8882 - DNA, 20 bp, Artificial Sequence
  Description of Artificial Sequence: Synthetic oligonucleotide
caagagaagcttcctgcctg

SEQ ID NO: 8883 - DNA, 20 bp, Artificial Sequence
  Description of Artificial Sequence: Synthetic oligonucleotide
aagagaagcttcctgcctgc

SEQ ID NO: 8884 - DNA, 20 bp, Artificial Sequence
  Description of Artificial Sequence: Synthetic oligonucleotide
agagaagcttcctgcctgct

SEQ ID NO: 8885 - DNA, 20 bp, Artificial Sequence
  Description of Artificial Sequence: Synthetic oligonucleotide
gagaagcttcctgcctgcta

SEQ ID NO: 8886 - DNA, 20 bp, Artificial Sequence
  Description of Artificial Sequence: Synthetic oligonucleotide
agaagcttcctgcctgctat

SEQ ID NO: 8887 - DNA, 20 bp, Artificial Sequence
  Description of Artificial Sequence: Synthetic oligonucleotide
gaagcttcctgcctgctatg

SEQ ID NO: 8888 - DNA, 20 bp, Artificial Sequence
  Description of Artificial Sequence: Synthetic oligonucleotide
aagcttcctgcctgctatgt

SEQ ID NO: 8889 - DNA, 20 bp, Artificial Sequence
  Description of Artificial Sequence: Synthetic oligonucleotide
agcttcctgcctgctatgtc

SEQ ID NO: 8890 - DNA, 20 bp, Artificial Sequence
  Description of Artificial Sequence: Synthetic oligonucleotide
gcttcctgcctgctatgtct

SEQ ID NO: 8891 - DNA, 20 bp, Artificial Sequence
  Description of Artificial Sequence: Synthetic oligonucleotide
cttcctgcctgctatgtctc

SEQ ID NO: 8892 - DNA, 20 bp, Artificial Sequence
  Description of Artificial Sequence: Synthetic oligonucleotide
ttcctgcctgctatgtctcg

SEQ ID NO: 8893 - DNA, 20 bp, Artificial Sequence
  Description of Artificial Sequence: Synthetic oligonucleotide
tcctgcctgctatgtctcgg

SEQ ID NO: 8894 - DNA, 20 bp, Artificial Sequence
  Description of Artificial Sequence: Synthetic oligonucleotide
cctgcctgctatgtctcggg

SEQ ID NO: 8895 - DNA, 20 bp, Artificial Sequence
  Description of Artificial Sequence: Synthetic oligonucleotide
ctgcctgctatgtctcgggg

SEQ ID NO: 8896 - DNA, 20 bp, Artificial Sequence
  Description of Artificial Sequence: Synthetic oligonucleotide
tgcctgctatgtctcggggt

SEQ ID NO: 8897 - DNA, 20 bp, Artificial Sequence
  Description of Artificial Sequence: Synthetic oligonucleotide
gcctgctatgtctcggggtg

SEQ ID NO: 8898 - DNA, 20 bp, Artificial Sequence
  Description of Artificial Sequence: Synthetic oligonucleotide
cctgctatgtctcggggtgc

SEQ ID NO: 8899 - DNA, 20 bp, Artificial Sequence
  Description of Artificial Sequence: Synthetic oligonucleotide
ctgctatgtctcggggtgct

SEQ ID NO: 8900 - DNA, 20 bp, Artificial Sequence
  Description of Artificial Sequence: Synthetic oligonucleotide
tgctatgtctcggggtgctt

SEQ ID NO: 8901 - DNA, 20 bp, Artificial Sequence
  Description of Artificial Sequence: Synthetic oligonucleotide
gctatgtctcggggtgcttt

SEQ ID NO: 8902 - DNA, 20 bp, Artificial Sequence
  Description of Artificial Sequence: Synthetic oligonucleotide
ctatgtctcggggtgctttt

SEQ ID NO: 8903 - DNA, 20 bp, Artificial Sequence
  Description of Artificial Sequence: Synthetic oligonucleotide
tatgtctcggggtgcttttc

SEQ ID NO: 8904 - DNA, 20 bp, Artificial Sequence
  Description of Artificial Sequence: Synthetic oligonucleotide
atgtctcggggtgcttttct

SEQ ID NO: 8905 - DNA, 20 bp, Artificial Sequence
  Description of Artificial Sequence: Synthetic oligonucleotide
tgtctcggggtgcttttctt

SEQ ID NO: 8906 - DNA, 20 bp, Artificial Sequence
  Description of Artificial Sequence: Synthetic oligonucleotide
gtctcggggtgcttttcttg

SEQ ID NO: 8907 - DNA, 20 bp, Artificial Sequence
  Description of Artificial Sequence: Synthetic oligonucleotide
tctcggggtgcttttcttgg

SEQ ID NO: 8908 - DNA, 20 bp, Artificial Sequence
  Description of Artificial Sequence: Synthetic oligonucleotide
ctcggggtgcttttcttggt

SEQ ID NO: 8909 - DNA, 20 bp, Artificial Sequence
  Description of Artificial Sequence: Synthetic oligonucleotide
tcggggtgcttttcttggtg

SEQ ID NO: 8910 - DNA, 20 bp, Artificial Sequence
  Description of Artificial Sequence: Synthetic oligonucleotide
cggggtgcttttcttggtga

SEQ ID NO: 8911 - DNA, 20 bp, Artificial Sequence
  Description of Artificial Sequence: Synthetic oligonucleotide
ggggtgcttttcttggtgac

SEQ ID NO: 8912 - DNA, 20 bp, Artificial Sequence
  Description of Artificial Sequence: Synthetic oligonucleotide
gggtgcttttcttggtgacc

SEQ ID NO: 8913 - DNA, 20 bp, Artificial Sequence
  Description of Artificial Sequence: Synthetic oligonucleotide
ggtgcttttcttggtgacca

SEQ ID NO: 8914 - DNA, 20 bp, Artificial Sequence
  Description of Artificial Sequence: Synthetic oligonucleotide
gtgcttttcttggtgaccac

SEQ ID NO: 8915 - DNA, 20 bp, Artificial Sequence
  Description of Artificial Sequence: Synthetic oligonucleotide
tgcttttcttggtgaccact

SEQ ID NO: 8916 - DNA, 20 bp, Artificial Sequence
  Description of Artificial Sequence: Synthetic oligonucleotide
gcttttcttggtgaccactg

SEQ ID NO: 8917 - DNA, 20 bp, Artificial Sequence
  Description of Artificial Sequence: Synthetic oligonucleotide
cttttcttggtgaccactgc

SEQ ID NO: 8918 - DNA, 20 bp, Artificial Sequence
  Description of Artificial Sequence: Synthetic oligonucleotide
ttttcttggtgaccactgca

SEQ ID NO: 8919 - DNA, 20 bp, Artificial Sequence
  Description of Artificial Sequence: Synthetic oligonucleotide
tttcttggtgaccactgcac

SEQ ID NO: 8920 - DNA, 20 bp, Artificial Sequence
  Description of Artificial Sequence: Synthetic oligonucleotide
ttcttggtgaccactgcact

SEQ ID NO: 8921 - DNA, 20 bp, Artificial Sequence
  Description of Artificial Sequence: Synthetic oligonucleotide
tcttggtgaccactgcactg

SEQ ID NO: 8922 - DNA, 20 bp, Artificial Sequence
  Description of Artificial Sequence: Synthetic oligonucleotide
cttggtgaccactgcactgg

SEQ ID NO: 8923 - DNA, 20 bp, Artificial Sequence
  Description of Artificial Sequence: Synthetic oligonucleotide
ttggtgaccactgcactggg

SEQ ID NO: 8924 - DNA, 20 bp, Artificial Sequence
  Description of Artificial Sequence: Synthetic oligonucleotide
tggtgaccactgcactggga

SEQ ID NO: 8925 - DNA, 20 bp, Artificial Sequence
  Description of Artificial Sequence: Synthetic oligonucleotide
ggtgaccactgcactgggac

SEQ ID NO: 8926 - DNA, 20 bp, Artificial Sequence
  Description of Artificial Sequence: Synthetic oligonucleotide
gtgaccactgcactgggacc

SEQ ID NO: 8927 - DNA, 20 bp, Artificial Sequence
  Description of Artificial Sequence: Synthetic oligonucleotide
tgaccactgcactgggacct

SEQ ID NO: 8928 - DNA, 20 bp, Artificial Sequence
  Description of Artificial Sequence: Synthetic oligonucleotide
gaccactgcactgggacctt

SEQ ID NO: 8929 - DNA, 20 bp, Artificial Sequence
  Description of Artificial Sequence: Synthetic oligonucleotide
accactgcactgggacctta

SEQ ID NO: 8930 - DNA, 20 bp, Artificial Sequence
  Description of Artificial Sequence: Synthetic oligonucleotide
ccactgcactgggaccttag

SEQ ID NO: 8931 - DNA, 20 bp, Artificial Sequence
  Description of Artificial Sequence: Synthetic oligonucleotide
cactgcactgggaccttaga

SEQ ID NO: 8932 - DNA, 20 bp, Artificial Sequence
  Description of Artificial Sequence: Synthetic oligonucleotide
actgcactgggaccttagag

SEQ ID NO: 8933 - DNA, 20 bp, Artificial Sequence
  Description of Artificial Sequence: Synthetic oligonucleotide
ctgcactgggaccttagaga

SEQ ID NO: 8934 - DNA, 20 bp, Artificial Sequence
  Description of Artificial Sequence: Synthetic oligonucleotide
tgcactgggaccttagagag

SEQ ID NO: 8935 - DNA, 20 bp, Artificial Sequence
  Description of Artificial Sequence: Synthetic oligonucleotide
gcactgggaccttagagagg

SEQ ID NO: 8936 - DNA, 20 bp, Artificial Sequence
  Description of Artificial Sequence: Synthetic oligonucleotide
cactgggaccttagagagga

SEQ ID NO: 8937 - DNA, 20 bp, Artificial Sequence
  Description of Artificial Sequence: Synthetic oligonucleotide
actgggaccttagagaggag

SEQ ID NO: 8938 - DNA, 20 bp, Artificial Sequence
  Description of Artificial Sequence: Synthetic oligonucleotide
ctgggaccttagagaggagc

SEQ ID NO: 8939 - DNA, 20 bp, Artificial Sequence
  Description of Artificial Sequence: Synthetic oligonucleotide
tgggaccttagagaggagca

SEQ ID NO: 8940 - DNA, 20 bp, Artificial Sequence
  Description of Artificial Sequence: Synthetic oligonucleotide
gggaccttagagaggagcac

SEQ ID NO: 8941 - DNA, 20 bp, Artificial Sequence
  Description of Artificial Sequence: Synthetic oligonucleotide
ggaccttagagaggagcacc

SEQ ID NO: 8942 - DNA, 20 bp, Artificial Sequence
  Description of Artificial Sequence: Synthetic oligonucleotide
gaccttagagaggagcacca

SEQ ID NO: 8943 - DNA, 20 bp, Artificial Sequence
  Description of Artificial Sequence: Synthetic oligonucleotide
accttagagaggagcaccaa

SEQ ID NO: 8944 - DNA, 20 bp, Artificial Sequence
  Description of Artificial Sequence: Synthetic oligonucleotide
ccttagagaggagcaccaag

SEQ ID NO: 8945 - DNA, 20 bp, Artificial Sequence
  Description of Artificial Sequence: Synthetic oligonucleotide
cttagagaggagcaccaaga

SEQ ID NO: 8946 - DNA, 20 bp, Artificial Sequence
  Description of Artificial Sequence: Synthetic oligonucleotide
ttagagaggagcaccaagat

SEQ ID NO: 8947 - DNA, 20 bp, Artificial Sequence
  Description of Artificial Sequence: Synthetic oligonucleotide
tagagaggagcaccaagatg

SEQ ID NO: 8948 - DNA, 20 bp, Artificial Sequence
  Description of Artificial Sequence: Synthetic oligonucleotide
agagaggagcaccaagatgg

SEQ ID NO: 8949 - DNA, 20 bp, Artificial Sequence
  Description of Artificial Sequence: Synthetic oligonucleotide
gagaggagcaccaagatggc

SEQ ID NO: 8950 - DNA, 20 bp, Artificial Sequence
  Description of Artificial Sequence: Synthetic oligonucleotide
agaggagcaccaagatggca

SEQ ID NO: 8951 - DNA, 20 bp, Artificial Sequence
  Description of Artificial Sequence: Synthetic oligonucleotide
gaggagcaccaagatggcag

SEQ ID NO: 8952 - DNA, 20 bp, Artificial Sequence
  Description of Artificial Sequence: Synthetic oligonucleotide
aggagcaccaagatggcaga

SEQ ID NO: 8953 - DNA, 20 bp, Artificial Sequence
  Description of Artificial Sequence: Synthetic oligonucleotide
ggagcaccaagatggcagat

SEQ ID NO: 8954 - DNA, 20 bp, Artificial Sequence
  Description of Artificial Sequence: Synthetic oligonucleotide
gagcaccaagatggcagatg

SEQ ID NO: 8955 - DNA, 20 bp, Artificial Sequence
  Description of Artificial Sequence: Synthetic oligonucleotide
agcaccaagatggcagatgg

SEQ ID NO: 8956 - DNA, 20 bp, Artificial Sequence
  Description of Artificial Sequence: Synthetic oligonucleotide
gcaccaagatggcagatggg

SEQ ID NO: 8957 - DNA, 20 bp, Artificial Sequence
  Description of Artificial Sequence: Synthetic oligonucleotide
caccaagatggcagatggga

SEQ ID NO: 8958 - DNA, 20 bp, Artificial Sequence
  Description of Artificial Sequence: Synthetic oligonucleotide
accaagatggcagatgggag

SEQ ID NO: 8959 - DNA, 20 bp, Artificial Sequence
  Description of Artificial Sequence: Synthetic oligonucleotide
ccaagatggcagatgggagt

SEQ ID NO: 8960 - DNA, 20 bp, Artificial Sequence
  Description of Artificial Sequence: Synthetic oligonucleotide
caagatggcagatgggagtt

SEQ ID NO: 8961 - DNA, 20 bp, Artificial Sequence
  Description of Artificial Sequence: Synthetic oligonucleotide
aagatggcagatgggagttg

SEQ ID NO: 8962 - DNA, 20 bp, Artificial Sequence
  Description of Artificial Sequence: Synthetic oligonucleotide
agatggcagatgggagttgt

SEQ ID NO: 8963 - DNA, 20 bp, Artificial Sequence
  Description of Artificial Sequence: Synthetic oligonucleotide
gatggcagatgggagttgtc

SEQ ID NO: 8964 - DNA, 20 bp, Artificial Sequence
  Description of Artificial Sequence: Synthetic oligonucleotide
atggcagatgggagttgtct

SEQ ID NO: 8965 - DNA, 20 bp, Artificial Sequence
  Description of Artificial Sequence: Synthetic oligonucleotide
tggcagatgggagttgtctg

SEQ ID NO: 8966 - DNA, 20 bp, Artificial Sequence
  Description of Artificial Sequence: Synthetic oligonucleotide
ggcagatgggagttgtctga

SEQ ID NO: 8967 - DNA, 20 bp, Artificial Sequence
  Description of Artificial Sequence: Synthetic oligonucleotide
gcagatgggagttgtctgag

SEQ ID NO: 8968 - DNA, 20 bp, Artificial Sequence
  Description of Artificial Sequence: Synthetic oligonucleotide
cagatgggagttgtctgagg

SEQ ID NO: 8969 - DNA, 20 bp, Artificial Sequence
  Description of Artificial Sequence: Synthetic oligonucleotide
agatgggagttgtctgaggc

SEQ ID NO: 8970 - DNA, 20 bp, Artificial Sequence
  Description of Artificial Sequence: Synthetic oligonucleotide
gatgggagttgtctgaggca

SEQ ID NO: 8971 - DNA, 20 bp, Artificial Sequence
  Description of Artificial Sequence: Synthetic oligonucleotide
atgggagttgtctgaggcac

SEQ ID NO: 8972 - DNA, 20 bp, Artificial Sequence
  Description of Artificial Sequence: Synthetic oligonucleotide
tgggagttgtctgaggcaca

SEQ ID NO: 8973 - DNA, 20 bp, Artificial Sequence
  Description of Artificial Sequence: Synthetic oligonucleotide
gggagttgtctgaggcacat

SEQ ID NO: 8974 - DNA, 20 bp, Artificial Sequence
  Description of Artificial Sequence: Synthetic oligonucleotide
ggagttgtctgaggcacata

SEQ ID NO: 8975 - DNA, 20 bp, Artificial Sequence
  Description of Artificial Sequence: Synthetic oligonucleotide
gagttgtctgaggcacatag

SEQ ID NO: 8976 - DNA, 20 bp, Artificial Sequence
  Description of Artificial Sequence: Synthetic oligonucleotide
agttgtctgaggcacatagg

SEQ ID NO: 8977 - DNA, 20 bp, Artificial Sequence
  Description of Artificial Sequence: Synthetic oligonucleotide
gttgtctgaggcacataggt

SEQ ID NO: 8978 - DNA, 20 bp, Artificial Sequence
  Description of Artificial Sequence: Synthetic oligonucleotide
ttgtctgaggcacataggtt

SEQ ID NO: 8979 - DNA, 20 bp, Artificial Sequence
  Description of Artificial Sequence: Synthetic oligonucleotide
tgtctgaggcacataggttc

SEQ ID NO: 8980 - DNA, 20 bp, Artificial Sequence
  Description of Artificial Sequence: Synthetic oligonucleotide
gtctgaggcacataggttct

SEQ ID NO: 8981 - DNA, 20 bp, Artificial Sequence
  Description of Artificial Sequence: Synthetic oligonucleotide
tctgaggcacataggttctc

SEQ ID NO: 8982 - DNA, 20 bp, Artificial Sequence
  Description of Artificial Sequence: Synthetic oligonucleotide
ctgaggcacataggttctct

SEQ ID NO: 8983 - DNA, 20 bp, Artificial Sequence
  Description of Artificial Sequence: Synthetic oligonucleotide
tgaggcacataggttctctt

SEQ ID NO: 8984 - DNA, 20 bp, Artificial Sequence
  Description of Artificial Sequence: Synthetic oligonucleotide
gaggcacataggttctcttg

SEQ ID NO: 8985 - DNA, 20 bp, Artificial Sequence
  Description of Artificial Sequence: Synthetic oligonucleotide
aggcacataggttctcttgc

SEQ ID NO: 8986 - DNA, 20 bp, Artificial Sequence
  Description of Artificial Sequence: Synthetic oligonucleotide
ggcacataggttctcttgca

SEQ ID NO: 8987 - DNA, 20 bp, Artificial Sequence
  Description of Artificial Sequence: Synthetic oligonucleotide
gcacataggttctcttgcag

SEQ ID NO: 8988 - DNA, 20 bp, Artificial Sequence
  Description of Artificial Sequence: Synthetic oligonucleotide
cacataggttctcttgcaga

SEQ ID NO: 8989 - DNA, 20 bp, Artificial Sequence
  Description of Artificial Sequence: Synthetic oligonucleotide
acataggttctcttgcagag

SEQ ID NO: 8990 - DNA, 20 bp, Artificial Sequence
  Description of Artificial Sequence: Synthetic oligonucleotide
cataggttctcttgcagagc

SEQ ID NO: 8991 - DNA, 20 bp, Artificial Sequence
  Description of Artificial Sequence: Synthetic oligonucleotide
ataggttctcttgcagagca

SEQ ID NO: 8992 - DNA, 20 bp, Artificial Sequence
  Description of Artificial Sequence: Synthetic oligonucleotide
taggttctcttgcagagcac

SEQ ID NO: 8993 - DNA, 20 bp, Artificial Sequence
  Description of Artificial Sequence: Synthetic oligonucleotide
aggttctcttgcagagcacc

SEQ ID NO: 8994 - DNA, 20 bp, Artificial Sequence
  Description of Artificial Sequence: Synthetic oligonucleotide
ggttctcttgcagagcacct

SEQ ID NO: 8995 - DNA, 20 bp, Artificial Sequence
  Description of Artificial Sequence: Synthetic oligonucleotide
gttctcttgcagagcacctt

SEQ ID NO: 8996 - DNA, 20 bp, Artificial Sequence
  Description of Artificial Sequence: Synthetic oligonucleotide
ttctcttgcagagcaccttg

SEQ ID NO: 8997 - DNA, 20 bp, Artificial Sequence
  Description of Artificial Sequence: Synthetic oligonucleotide
tctcttgcagagcaccttgg

SEQ ID NO: 8998 - DNA, 20 bp, Artificial Sequence
  Description of Artificial Sequence: Synthetic oligonucleotide
ctcttgcagagcaccttggg

SEQ ID NO: 8999 - DNA, 20 bp, Artificial Sequence
  Description of Artificial Sequence: Synthetic oligonucleotide
tcttgcagagcaccttggga

SEQ ID NO: 9000 - DNA, 20 bp, Artificial Sequence
  Description of Artificial Sequence: Synthetic oligonucleotide
cttgcagagcaccttgggaa

SEQ ID NO: 9001 - DNA, 20 bp, Artificial Sequence
  Description of Artificial Sequence: Synthetic oligonucleotide
ttgcagagcaccttgggaaa

SEQ ID NO: 9002 - DNA, 20 bp, Artificial Sequence
  Description of Artificial Sequence: Synthetic oligonucleotide
tgcagagcaccttgggaaag

SEQ ID NO: 9003 - DNA, 20 bp, Artificial Sequence
  Description of Artificial Sequence: Synthetic oligonucleotide
gcagagcaccttgggaaagg

SEQ ID NO: 9004 - DNA, 20 bp, Artificial Sequence
  Description of Artificial Sequence: Synthetic oligonucleotide
cagagcaccttgggaaaggg

SEQ ID NO: 9005 - DNA, 20 bp, Artificial Sequence
  Description of Artificial Sequence: Synthetic oligonucleotide
agagcaccttgggaaaggga

SEQ ID NO: 9006 - DNA, 20 bp, Artificial Sequence
  Description of Artificial Sequence: Synthetic oligonucleotide
gagcaccttgggaaagggag

SEQ ID NO: 9007 - DNA, 20 bp, Artificial Sequence
  Description of Artificial Sequence: Synthetic oligonucleotide
agcaccttgggaaagggagg

SEQ ID NO: 9008 - DNA, 20 bp, Artificial Sequence
  Description of Artificial Sequence: Synthetic oligonucleotide
gcaccttgggaaagggaggt

SEQ ID NO: 9009 - DNA, 20 bp, Artificial Sequence
  Description of Artificial Sequence: Synthetic oligonucleotide
caccttgggaaagggaggta

SEQ ID NO: 9010 - DNA, 20 bp, Artificial Sequence
  Description of Artificial Sequence: Synthetic oligonucleotide
accttgggaaagggaggtag

SEQ ID NO: 9011 - DNA, 20 bp, Artificial Sequence
  Description of Artificial Sequence: Synthetic oligonucleotide
ccttgggaaagggaggtaga

SEQ ID NO: 9012 - DNA, 20 bp, Artificial Sequence
  Description of Artificial Sequence: Synthetic oligonucleotide
cttgggaaagggaggtagag

SEQ ID NO: 9013 - DNA, 20 bp, Artificial Sequence
  Description of Artificial Sequence: Synthetic oligonucleotide
ttgggaaagggaggtagagt

SEQ ID NO: 9014 - DNA, 20 bp, Artificial Sequence
  Description of Artificial Sequence: Synthetic oligonucleotide
tgggaaagggaggtagagta

SEQ ID NO: 9015 - DNA, 20 bp, Artificial Sequence
  Description of Artificial Sequence: Synthetic oligonucleotide
gggaaagggaggtagagtac

SEQ ID NO: 9016 - DNA, 20 bp, Artificial Sequence
  Description of Artificial Sequence: Synthetic oligonucleotide
ggaaagggaggtagagtacg

SEQ ID NO: 9017 - DNA, 20 bp, Artificial Sequence
  Description of Artificial Sequence: Synthetic oligonucleotide
gaaagggaggtagagtacgt

SEQ ID NO: 9018 - DNA, 20 bp, Artificial Sequence
  Description of Artificial Sequence: Synthetic oligonucleotide
aaagggaggtagagtacgtg

SEQ ID NO: 9019 - DNA, 20 bp, Artificial Sequence
  Description of Artificial Sequence: Synthetic oligonucleotide
aagggaggtagagtacgtgt

SEQ ID NO: 9020 - DNA, 20 bp, Artificial Sequence
  Description of Artificial Sequence: Synthetic oligonucleotide
agggaggtagagtacgtgtg

SEQ ID NO: 9021 - DNA, 20 bp, Artificial Sequence
  Description of Artificial Sequence: Synthetic oligonucleotide
gggaggtagagtacgtgtgc

SEQ ID NO: 9022 - DNA, 20 bp, Artificial Sequence
  Description of Artificial Sequence: Synthetic oligonucleotide
ggaggtagagtacgtgtgcc

SEQ ID NO: 9023 - DNA, 20 bp, Artificial Sequence
  Description of Artificial Sequence: Synthetic oligonucleotide
gaggtagagtacgtgtgcct

SEQ ID NO: 9024 - DNA, 20 bp, Artificial Sequence
  Description of Artificial Sequence: Synthetic oligonucleotide
aggtagagtacgtgtgcctt

SEQ ID NO: 9025 - DNA, 20 bp, Artificial Sequence
  Description of Artificial Sequence: Synthetic oligonucleotide
ggtagagtacgtgtgccttc

SEQ ID NO: 9026 - DNA, 20 bp, Artificial Sequence
  Description of Artificial Sequence: Synthetic oligonucleotide
gtagagtacgtgtgccttcg

SEQ ID NO: 9027 - DNA, 20 bp, Artificial Sequence
  Description of Artificial Sequence: Synthetic oligonucleotide
tagagtacgtgtgccttcgc

SEQ ID NO: 9028 - DNA, 20 bp, Artificial Sequence
  Description of Artificial Sequence: Synthetic oligonucleotide
agagtacgtgtgccttcgcc

SEQ ID NO: 9029 - DNA, 20 bp, Artificial Sequence
  Description of Artificial Sequence: Synthetic oligonucleotide
gagtacgtgtgccttcgcca

SEQ ID NO: 9030 - DNA, 20 bp, Artificial Sequence
  Description of Artificial Sequence: Synthetic oligonucleotide
agtacgtgtgccttcgccat

SEQ ID NO: 9031 - DNA, 20 bp, Artificial Sequence
  Description of Artificial Sequence: Synthetic oligonucleotide
gtacgtgtgccttcgccatc

SEQ ID NO: 9032 - DNA, 20 bp, Artificial Sequence
  Description of Artificial Sequence: Synthetic oligonucleotide
tacgtgtgccttcgccatca

SEQ ID NO: 9033 - DNA, 20 bp, Artificial Sequence
  Description of Artificial Sequence: Synthetic oligonucleotide
acgtgtgccttcgccatcac

SEQ ID NO: 9034 - DNA, 20 bp, Artificial Sequence
  Description of Artificial Sequence: Synthetic oligonucleotide
cgtgtgccttcgccatcact

SEQ ID NO: 9035 - DNA, 20 bp, Artificial Sequence
  Description of Artificial Sequence: Synthetic oligonucleotide
gtgtgccttcgccatcacta

SEQ ID NO: 9036 - DNA, 20 bp, Artificial Sequence
  Description of Artificial Sequence: Synthetic oligonucleotide
tgtgccttcgccatcactat

SEQ ID NO: 9037 - DNA, 20 bp, Artificial Sequence
  Description of Artificial Sequence: Synthetic oligonucleotide
gtgccttcgccatcactatt

SEQ ID NO: 9038 - DNA, 20 bp, Artificial Sequence
  Description of Artificial Sequence: Synthetic oligonucleotide
tgccttcgccatcactattc

SEQ ID NO: 9039 - DNA, 20 bp, Artificial Sequence
  Description of Artificial Sequence: Synthetic oligonucleotide
gccttcgccatcactattct

SEQ ID NO: 9040 - DNA, 20 bp, Artificial Sequence
  Description of Artificial Sequence: Synthetic oligonucleotide
ccttcgccatcactattctt

SEQ ID NO: 9041 - DNA, 20 bp, Artificial Sequence
  Description of Artificial Sequence: Synthetic oligonucleotide
cttcgccatcactattcttc

SEQ ID NO: 9042 - DNA, 20 bp, Artificial Sequence
  Description of Artificial Sequence: Synthetic oligonucleotide
ttcgccatcactattcttca

SEQ ID NO: 9043 - DNA, 20 bp, Artificial Sequence
  Description of Artificial Sequence: Synthetic oligonucleotide
tcgccatcactattcttcat

SEQ ID NO: 9044 - DNA, 20 bp, Artificial Sequence
  Description of Artificial Sequence: Synthetic oligonucleotide
cgccatcactattcttcatt

SEQ ID NO: 9045 - DNA, 20 bp, Artificial Sequence
  Description of Artificial Sequence: Synthetic oligonucleotide
gccatcactattcttcattt

SEQ ID NO: 9046 - DNA, 20 bp, Artificial Sequence
  Description of Artificial Sequence: Synthetic oligonucleotide
ccatcactattcttcatttc

SEQ ID NO: 9047 - DNA, 20 bp, Artificial Sequence
  Description of Artificial Sequence: Synthetic oligonucleotide
catcactattcttcatttcg

SEQ ID NO: 9048 - DNA, 20 bp, Artificial Sequence
  Description of Artificial Sequence: Synthetic oligonucleotide
atcactattcttcatttcgt

SEQ ID NO: 9049 - DNA, 20 bp, Artificial Sequence
  Description of Artificial Sequence: Synthetic oligonucleotide
tcactattcttcatttcgtc

SEQ ID NO: 9050 - DNA, 20 bp, Artificial Sequence
  Description of Artificial Sequence: Synthetic oligonucleotide
cactattcttcatttcgtct

SEQ ID NO: 9051 - DNA, 20 bp, Artificial Sequence
  Description of Artificial Sequence: Synthetic oligonucleotide
actattcttcatttcgtctt

SEQ ID NO: 9052 - DNA, 20 bp, Artificial Sequence
  Description of Artificial Sequence: Synthetic oligonucleotide
ctattcttcatttcgtctta

SEQ ID NO: 9053 - DNA, 20 bp, Artificial Sequence
  Description of Artificial Sequence: Synthetic oligonucleotide
tattcttcatttcgtcttag

SEQ ID NO: 9054 - DNA, 20 bp, Artificial Sequence
  Description of Artificial Sequence: Synthetic oligonucleotide
attcttcatttcgtcttagt

SEQ ID NO: 9055 - DNA, 20 bp, Artificial Sequence
  Description of Artificial Sequence: Synthetic oligonucleotide
ttcttcatttcgtcttagtg

SEQ ID NO: 9056 - DNA, 20 bp, Artificial Sequence
  Description of Artificial Sequence: Synthetic oligonucleotide
tcttcatttcgtcttagtgg

SEQ ID NO: 9057 - DNA, 20 bp, Artificial Sequence
  Description of Artificial Sequence: Synthetic oligonucleotide
cttcatttcgtcttagtggt

SEQ ID NO: 9058 - DNA, 20 bp, Artificial Sequence
  Description of Artificial Sequence: Synthetic oligonucleotide
ttcatttcgtcttagtggtg

SEQ ID NO: 9059 - DNA, 20 bp, Artificial Sequence
  Description of Artificial Sequence: Synthetic oligonucleotide
tcatttcgtcttagtggtga

SEQ ID NO: 9060 - DNA, 20 bp, Artificial Sequence
  Description of Artificial Sequence: Synthetic oligonucleotide
catttcgtcttagtggtgaa

SEQ ID NO: 9061 - DNA, 20 bp, Artificial Sequence
  Description of Artificial Sequence: Synthetic oligonucleotide
atttcgtcttagtggtgaaa

SEQ ID NO: 9062 - DNA, 20 bp, Artificial Sequence
  Description of Artificial Sequence: Synthetic oligonucleotide
tttcgtcttagtggtgaaag

SEQ ID NO: 9063 - DNA, 20 bp, Artificial Sequence
  Description of Artificial Sequence: Synthetic oligonucleotide
ttcgtcttagtggtgaaagc

SEQ ID NO: 9064 - DNA, 20 bp, Artificial Sequence
  Description of Artificial Sequence: Synthetic oligonucleotide
tcgtcttagtggtgaaagca

SEQ ID NO: 9065 - DNA, 20 bp, Artificial Sequence
  Description of Artificial Sequence: Synthetic oligonucleotide
cgtcttagtggtgaaagcac

SEQ ID NO: 9066 - DNA, 20 bp, Artificial Sequence
  Description of Artificial Sequence: Synthetic oligonucleotide
gtcttagtggtgaaagcacc

SEQ ID NO: 9067 - DNA, 20 bp, Artificial Sequence
  Description of Artificial Sequence: Synthetic oligonucleotide
tcttagtggtgaaagcacca

SEQ ID NO: 9068 - DNA, 20 bp, Artificial Sequence
  Description of Artificial Sequence: Synthetic oligonucleotide
cttagtggtgaaagcaccaa

SEQ ID NO: 9069 - DNA, 20 bp, Artificial Sequence
  Description of Artificial Sequence: Synthetic oligonucleotide
ttagtggtgaaagcaccaac

SEQ ID NO: 9070 - DNA, 20 bp, Artificial Sequence
  Description of Artificial Sequence: Synthetic oligonucleotide
tagtggtgaaagcaccaact

SEQ ID NO: 9071 - DNA, 20 bp, Artificial Sequence
  Description of Artificial Sequence: Synthetic oligonucleotide
agtggtgaaagcaccaactt

SEQ ID NO: 9072 - DNA, 20 bp, Artificial Sequence
  Description of Artificial Sequence: Synthetic oligonucleotide
gtggtgaaagcaccaactta

SEQ ID NO: 9073 - DNA, 20 bp, Artificial Sequence
  Description of Artificial Sequence: Synthetic oligonucleotide
tggtgaaagcaccaacttac

SEQ ID NO: 9074 - DNA, 20 bp, Artificial Sequence
  Description of Artificial Sequence: Synthetic oligonucleotide
ggtgaaagcaccaacttact

SEQ ID NO: 9075 - DNA, 20 bp, Artificial Sequence
  Description of Artificial Sequence: Synthetic oligonucleotide
gtgaaagcaccaacttactg

SEQ ID NO: 9076 - DNA, 20 bp, Artificial Sequence
  Description of Artificial Sequence: Synthetic oligonucleotide
tgaaagcaccaacttactgc

SEQ ID NO: 9077 - DNA, 20 bp, Artificial Sequence
  Description of Artificial Sequence: Synthetic oligonucleotide
gaaagcaccaacttactgct

SEQ ID NO: 9078 - DNA, 20 bp, Artificial Sequence
  Description of Artificial Sequence: Synthetic oligonucleotide
aaagcaccaacttactgctt

SEQ ID NO: 9079 - DNA, 20 bp, Artificial Sequence
  Description of Artificial Sequence: Synthetic oligonucleotide
aagcaccaacttactgcttc

SEQ ID NO: 9080 - DNA, 20 bp, Artificial Sequence
  Description of Artificial Sequence: Synthetic oligonucleotide
agcaccaacttactgcttcc

SEQ ID NO: 9081 - DNA, 20 bp, Artificial Sequence
  Description of Artificial Sequence: Synthetic oligonucleotide
gcaccaacttactgcttcct

SEQ ID NO: 9082 - DNA, 20 bp, Artificial Sequence
  Description of Artificial Sequence: Synthetic oligonucleotide
caccaacttactgcttcctc

SEQ ID NO: 9083 - DNA, 20 bp, Artificial Sequence
  Description of Artificial Sequence: Synthetic oligonucleotide
accaacttactgcttcctct

SEQ ID NO: 9084 - DNA, 20 bp, Artificial Sequence
  Description of Artificial Sequence: Synthetic oligonucleotide
ccaacttactgcttcctcta

SEQ ID NO: 9085 - DNA, 20 bp, Artificial Sequence
  Description of Artificial Sequence: Synthetic oligonucleotide
caacttactgcttcctctaa

SEQ ID NO: 9086 - DNA, 20 bp, Artificial Sequence
  Description of Artificial Sequence: Synthetic oligonucleotide
aacttactgcttcctctaag

SEQ ID NO: 9087 - DNA, 20 bp, Artificial Sequence
  Description of Artificial Sequence: Synthetic oligonucleotide
acttactgcttcctctaagg

SEQ ID NO: 9088 - DNA, 20 bp, Artificial Sequence
  Description of Artificial Sequence: Synthetic oligonucleotide
cttactgcttcctctaaggg

SEQ ID NO: 9089 - DNA, 20 bp, Artificial Sequence
  Description of Artificial Sequence: Synthetic oligonucleotide
ttactgcttcctctaaggga

SEQ ID NO: 9090 - DNA, 20 bp, Artificial Sequence
  Description of Artificial Sequence: Synthetic oligonucleotide
tactgcttcctctaagggac

SEQ ID NO: 9091 - DNA, 20 bp, Artificial Sequence
  Description of Artificial Sequence: Synthetic oligonucleotide
actgcttcctctaagggact

SEQ ID NO: 9092 - DNA, 20 bp, Artificial Sequence
  Description of Artificial Sequence: Synthetic oligonucleotide
ctgcttcctctaagggacta

SEQ ID NO: 9093 - DNA, 20 bp, Artificial Sequence
  Description of Artificial Sequence: Synthetic oligonucleotide
tgcttcctctaagggactac

SEQ ID NO: 9094 - DNA, 20 bp, Artificial Sequence
  Description of Artificial Sequence: Synthetic oligonucleotide
gcttcctctaagggactacc

SEQ ID NO: 9095 - DNA, 20 bp, Artificial Sequence
  Description of Artificial Sequence: Synthetic oligonucleotide
cttcctctaagggactacct

SEQ ID NO: 9096 - DNA, 20 bp, Artificial Sequence
  Description of Artificial Sequence: Synthetic oligonucleotide
ttcctctaagggactaccta

SEQ ID NO: 9097 - DNA, 20 bp, Artificial Sequence
  Description of Artificial Sequence: Synthetic oligonucleotide
tcctctaagggactacctac

SEQ ID NO: 9098 - DNA, 20 bp, Artificial Sequence
  Description of Artificial Sequence: Synthetic oligonucleotide
cctctaagggactacctact

SEQ ID NO: 9099 - DNA, 20 bp, Artificial Sequence
  Description of Artificial Sequence: Synthetic oligonucleotide
ctctaagggactacctactt

SEQ ID NO: 9100 - DNA, 20 bp, Artificial Sequence
  Description of Artificial Sequence: Synthetic oligonucleotide
tctaagggactacctactta

SEQ ID NO: 9101 - DNA, 20 bp, Artificial Sequence
  Description of Artificial Sequence: Synthetic oligonucleotide
ctaagggactacctacttat

SEQ ID NO: 9102 - DNA, 20 bp, Artificial Sequence
  Description of Artificial Sequence: Synthetic oligonucleotide
taagggactacctacttata

SEQ ID NO: 9103 - DNA, 20 bp, Artificial Sequence
  Description of Artificial Sequence: Synthetic oligonucleotide
aagggactacctacttatag

SEQ ID NO: 9104 - DNA, 20 bp, Artificial Sequence
  Description of Artificial Sequence: Synthetic oligonucleotide
agggactacctacttataga

SEQ ID NO: 9105 - DNA, 20 bp, Artificial Sequence
  Description of Artificial Sequence: Synthetic oligonucleotide
gggactacctacttatagaa

SEQ ID NO: 9106 - DNA, 20 bp, Artificial Sequence
  Description of Artificial Sequence: Synthetic oligonucleotide
ggactacctacttatagaat

SEQ ID NO: 9107 - DNA, 20 bp, Artificial Sequence
  Description of Artificial Sequence: Synthetic oligonucleotide
gactacctacttatagaata

SEQ ID NO: 9108 - DNA, 20 bp, Artificial Sequence
  Description of Artificial Sequence: Synthetic oligonucleotide
actacctacttatagaatat

SEQ ID NO: 9109 - DNA, 20 bp, Artificial Sequence
  Description of Artificial Sequence: Synthetic oligonucleotide
ctacctacttatagaatata

SEQ ID NO: 9110 - DNA, 20 bp, Artificial Sequence
  Description of Artificial Sequence: Synthetic oligonucleotide
tacctacttatagaatataa

SEQ ID NO: 9111 - DNA, 20 bp, Artificial Sequence
  Description of Artificial Sequence: Synthetic oligonucleotide
acctacttatagaatataag

SEQ ID NO: 9112 - DNA, 20 bp, Artificial Sequence
  Description of Artificial Sequence: Synthetic oligonucleotide
cctacttatagaatataagg

SEQ ID NO: 9113 - DNA, 20 bp, Artificial Sequence
  Description of Artificial Sequence: Synthetic oligonucleotide
ctacttatagaatataaggg

SEQ ID NO: 9114 - DNA, 20 bp, Artificial Sequence
  Description of Artificial Sequence: Synthetic oligonucleotide
tacttatagaatataagggt

SEQ ID NO: 9115 - DNA, 20 bp, Artificial Sequence
  Description of Artificial Sequence: Synthetic oligonucleotide
acttatagaatataagggta

SEQ ID NO: 9116 - DNA, 20 bp, Artificial Sequence
  Description of Artificial Sequence: Synthetic oligonucleotide
cttatagaatataagggtaa

SEQ ID NO: 9117 - DNA, 20 bp, Artificial Sequence
  Description of Artificial Sequence: Synthetic oligonucleotide
ttatagaatataagggtaac

SEQ ID NO: 9118 - DNA, 20 bp, Artificial Sequence
  Description of Artificial Sequence: Synthetic oligonucleotide
tatagaatataagggtaact

SEQ ID NO: 9119 - DNA, 20 bp, Artificial Sequence
  Description of Artificial Sequence: Synthetic oligonucleotide
atagaatataagggtaactg

SEQ ID NO: 9120 - DNA, 20 bp, Artificial Sequence
  Description of Artificial Sequence: Synthetic oligonucleotide
tagaatataagggtaactga

SEQ ID NO: 9121 - DNA, 20 bp, Artificial Sequence
  Description of Artificial Sequence: Synthetic oligonucleotide
agaatataagggtaactgag

SEQ ID NO: 9122 - DNA, 20 bp, Artificial Sequence
  Description of Artificial Sequence: Synthetic oligonucleotide
gaatataagggtaactgagc

SEQ ID NO: 9123 - DNA, 20 bp, Artificial Sequence
  Description of Artificial Sequence: Synthetic oligonucleotide
aatataagggtaactgagca

SEQ ID NO: 9124 - DNA, 20 bp, Artificial Sequence
  Description of Artificial Sequence: Synthetic oligonucleotide
atataagggtaactgagcac

SEQ ID NO: 9125 - DNA, 20 bp, Artificial Sequence
  Description of Artificial Sequence: Synthetic oligonucleotide
tataagggtaactgagcact

SEQ ID NO: 9126 - DNA, 20 bp, Artificial Sequence
  Description of Artificial Sequence: Synthetic oligonucleotide
ataagggtaactgagcactt

SEQ ID NO: 9127 - DNA, 20 bp, Artificial Sequence
  Description of Artificial Sequence: Synthetic oligonucleotide
taagggtaactgagcacttg

SEQ ID NO: 9128 - DNA, 20 bp, Artificial Sequence
  Description of Artificial Sequence: Synthetic oligonucleotide
aagggtaactgagcacttgg

SEQ ID NO: 9129 - DNA, 20 bp, Artificial Sequence
  Description of Artificial Sequence: Synthetic oligonucleotide
agggtaactgagcacttggt

SEQ ID NO: 9130 - DNA, 20 bp, Artificial Sequence
  Description of Artificial Sequence: Synthetic oligonucleotide
gggtaactgagcacttggtc

SEQ ID NO: 9131 - DNA, 20 bp, Artificial Sequence
  Description of Artificial Sequence: Synthetic oligonucleotide
ggtaactgagcacttggtca

SEQ ID NO: 9132 - DNA, 20 bp, Artificial Sequence
  Description of Artificial Sequence: Synthetic oligonucleotide
gtaactgagcacttggtcat

SEQ ID NO: 9133 - DNA, 20 bp, Artificial Sequence
  Description of Artificial Sequence: Synthetic oligonucleotide
taactgagcacttggtcata

SEQ ID NO: 9134 - DNA, 20 bp, Artificial Sequence
  Description of Artificial Sequence: Synthetic oligonucleotide
aactgagcacttggtcatag

SEQ ID NO: 9135 - DNA, 20 bp, Artificial Sequence
  Description of Artificial Sequence: Synthetic oligonucleotide
actgagcacttggtcataga

SEQ ID NO: 9136 - DNA, 20 bp, Artificial Sequence
  Description of Artificial Sequence: Synthetic oligonucleotide
ctgagcacttggtcatagag

SEQ ID NO: 9137 - DNA, 20 bp, Artificial Sequence
  Description of Artificial Sequence: Synthetic oligonucleotide
tgagcacttggtcatagaga

SEQ ID NO: 9138 - DNA, 20 bp, Artificial Sequence
  Description of Artificial Sequence: Synthetic oligonucleotide
gagcacttggtcatagagaa

SEQ ID NO: 9139 - DNA, 20 bp, Artificial Sequence
  Description of Artificial Sequence: Synthetic oligonucleotide
agcacttggtcatagagaag

SEQ ID NO: 9140 - DNA, 20 bp, Artificial Sequence
  Description of Artificial Sequence: Synthetic oligonucleotide
gcacttggtcatagagaaga

SEQ ID NO: 9141 - DNA, 20 bp, Artificial Sequence
  Description of Artificial Sequence: Synthetic oligonucleotide
cacttggtcatagagaagaa

SEQ ID NO: 9142 - DNA, 20 bp, Artificial Sequence
  Description of Artificial Sequence: Synthetic oligonucleotide
acttggtcatagagaagaaa

SEQ ID NO: 9143 - DNA, 20 bp, Artificial Sequence
  Description of Artificial Sequence: Synthetic oligonucleotide
cttggtcatagagaagaaaa

SEQ ID NO: 9144 - DNA, 20 bp, Artificial Sequence
  Description of Artificial Sequence: Synthetic oligonucleotide
ttggtcatagagaagaaaaa

SEQ ID NO: 9145 - DNA, 20 bp, Artificial Sequence
  Description of Artificial Sequence: Synthetic oligonucleotide
tggtcatagagaagaaaaat

SEQ ID NO: 9146 - DNA, 20 bp, Artificial Sequence
  Description of Artificial Sequence: Synthetic oligonucleotide
ggtcatagagaagaaaaata

SEQ ID NO: 9147 - DNA, 20 bp, Artificial Sequence
  Description of Artificial Sequence: Synthetic oligonucleotide
gtcatagagaagaaaaataa

SEQ ID NO: 9148 - DNA, 20 bp, Artificial Sequence
  Description of Artificial Sequence: Synthetic oligonucleotide
tcatagagaagaaaaataag

SEQ ID NO: 9149 - DNA, 20 bp, Artificial Sequence
  Description of Artificial Sequence: Synthetic oligonucleotide
catagagaagaaaaataagg

SEQ ID NO: 9150 - DNA, 20 bp, Artificial Sequence
  Description of Artificial Sequence: Synthetic oligonucleotide
atagagaagaaaaataagga

SEQ ID NO: 9151 - DNA, 20 bp, Artificial Sequence
  Description of Artificial Sequence: Synthetic oligonucleotide
tagagaagaaaaataaggaa

SEQ ID NO: 9152 - DNA, 20 bp, Artificial Sequence
  Description of Artificial Sequence: Synthetic oligonucleotide
agagaagaaaaataaggaat

SEQ ID NO: 9153 - DNA, 20 bp, Artificial Sequence
  Description of Artificial Sequence: Synthetic oligonucleotide
gagaagaaaaataaggaatg

SEQ ID NO: 9154 - DNA, 20 bp, Artificial Sequence
  Description of Artificial Sequence: Synthetic oligonucleotide
agaagaaaaataaggaatga

SEQ ID NO: 9155 - DNA, 20 bp, Artificial Sequence
  Description of Artificial Sequence: Synthetic oligonucleotide
gaagaaaaataaggaatgat

SEQ ID NO: 9156 - DNA, 20 bp, Artificial Sequence
  Description of Artificial Sequence: Synthetic oligonucleotide
aagaaaaataaggaatgatg

SEQ ID NO: 9157 - DNA, 20 bp, Artificial Sequence
  Description of Artificial Sequence: Synthetic oligonucleotide
agaaaaataaggaatgatgt

SEQ ID NO: 9158 - DNA, 20 bp, Artificial Sequence
  Description of Artificial Sequence: Synthetic oligonucleotide
gaaaaataaggaatgatgtc

SEQ ID NO: 9159 - DNA, 20 bp, Artificial Sequence
  Description of Artificial Sequence: Synthetic oligonucleotide
aaaaataaggaatgatgtcc

SEQ ID NO: 9160 - DNA, 20 bp, Artificial Sequence
  Description of Artificial Sequence: Synthetic oligonucleotide
aaaataaggaatgatgtcct

SEQ ID NO: 9161 - DNA, 20 bp, Artificial Sequence
  Description of Artificial Sequence: Synthetic oligonucleotide
aaataaggaatgatgtcctg

SEQ ID NO: 9162 - DNA, 20 bp, Artificial Sequence
  Description of Artificial Sequence: Synthetic oligonucleotide
aataaggaatgatgtcctgg

SEQ ID NO: 9163 - DNA, 20 bp, Artificial Sequence
  Description of Artificial Sequence: Synthetic oligonucleotide
ataaggaatgatgtcctggg

SEQ ID NO: 9164 - DNA, 20 bp, Artificial Sequence
  Description of Artificial Sequence: Synthetic oligonucleotide
taaggaatgatgtcctgggc

SEQ ID NO: 9165 - DNA, 20 bp, Artificial Sequence
  Description of Artificial Sequence: Synthetic oligonucleotide
aaggaatgatgtcctgggca

SEQ ID NO: 9166 - DNA, 20 bp, Artificial Sequence
  Description of Artificial Sequence: Synthetic oligonucleotide
aggaatgatgtcctgggcaa

SEQ ID NO: 9167 - DNA, 20 bp, Artificial Sequence
  Description of Artificial Sequence: Synthetic oligonucleotide
ggaatgatgtcctgggcaag

SEQ ID NO: 9168 - DNA, 20 bp, Artificial Sequence
  Description of Artificial Sequence: Synthetic oligonucleotide
gaatgatgtcctgggcaaga

SEQ ID NO: 9169 - DNA, 20 bp, Artificial Sequence
  Description of Artificial Sequence: Synthetic oligonucleotide
aatgatgtcctgggcaagaa

SEQ ID NO: 9170 - DNA, 20 bp, Artificial Sequence
  Description of Artificial Sequence: Synthetic oligonucleotide
atgatgtcctgggcaagaag

SEQ ID NO: 9171 - DNA, 20 bp, Artificial Sequence
  Description of Artificial Sequence: Synthetic oligonucleotide
tgatgtcctgggcaagaaga

SEQ ID NO: 9172 - DNA, 20 bp, Artificial Sequence
  Description of Artificial Sequence: Synthetic oligonucleotide
gatgtcctgggcaagaagag

SEQ ID NO: 9173 - DNA, 20 bp, Artificial Sequence
  Description of Artificial Sequence: Synthetic oligonucleotide
atgtcctgggcaagaagagc

SEQ ID NO: 9174 - DNA, 20 bp, Artificial Sequence
  Description of Artificial Sequence: Synthetic oligonucleotide
tgtcctgggcaagaagagca

SEQ ID NO: 9175 - DNA, 20 bp, Artificial Sequence
  Description of Artificial Sequence: Synthetic oligonucleotide
gtcctgggcaagaagagcaa

SEQ ID NO: 9176 - DNA, 20 bp, Artificial Sequence
  Description of Artificial Sequence: Synthetic oligonucleotide
tcctgggcaagaagagcaag

SEQ ID NO: 9177 - DNA, 20 bp, Artificial Sequence
  Description of Artificial Sequence: Synthetic oligonucleotide
cctgggcaagaagagcaaga

SEQ ID NO: 9178 - DNA, 20 bp, Artificial Sequence
  Description of Artificial Sequence: Synthetic oligonucleotide
ctgggcaagaagagcaagag

SEQ ID NO: 9179 - DNA, 20 bp, Artificial Sequence
  Description of Artificial Sequence: Synthetic oligonucleotide
tgggcaagaagagcaagaga

SEQ ID NO: 9180 - DNA, 20 bp, Artificial Sequence
  Description of Artificial Sequence: Synthetic oligonucleotide
gggcaagaagagcaagagac

SEQ ID NO: 9181 - DNA, 20 bp, Artificial Sequence
  Description of Artificial Sequence: Synthetic oligonucleotide
ggcaagaagagcaagagacc

SEQ ID NO: 9182 - DNA, 20 bp, Artificial Sequence
  Description of Artificial Sequence: Synthetic oligonucleotide
gcaagaagagcaagagacct

SEQ ID NO: 9183 - DNA, 20 bp, Artificial Sequence
  Description of Artificial Sequence: Synthetic oligonucleotide
caagaagagcaagagacctg

SEQ ID NO: 9184 - DNA, 20 bp, Artificial Sequence
  Description of Artificial Sequence: Synthetic oligonucleotide
aagaagagcaagagacctgg

SEQ ID NO: 9185 - DNA, 20 bp, Artificial Sequence
  Description of Artificial Sequence: Synthetic oligonucleotide
agaagagcaagagacctggt

SEQ ID NO: 9186 - DNA, 20 bp, Artificial Sequence
  Description of Artificial Sequence: Synthetic oligonucleotide
gaagagcaagagacctggtg

SEQ ID NO: 9187 - DNA, 20 bp, Artificial Sequence
  Description of Artificial Sequence: Synthetic oligonucleotide
aagagcaagagacctggtgg

SEQ ID NO: 9188 - DNA, 20 bp, Artificial Sequence
  Description of Artificial Sequence: Synthetic oligonucleotide
agagcaagagacctggtggg

SEQ ID NO: 9189 - DNA, 20 bp, Artificial Sequence
  Description of Artificial Sequence: Synthetic oligonucleotide
gagcaagagacctggtggga

SEQ ID NO: 9190 - DNA, 20 bp, Artificial Sequence
  Description of Artificial Sequence: Synthetic oligonucleotide
agcaagagacctggtgggag

SEQ ID NO: 9191 - DNA, 20 bp, Artificial Sequence
  Description of Artificial Sequence: Synthetic oligonucleotide
gcaagagacctggtgggaga

SEQ ID NO: 9192 - DNA, 20 bp, Artificial Sequence
  Description of Artificial Sequence: Synthetic oligonucleotide
caagagacctggtgggagag

SEQ ID NO: 9193 - DNA, 20 bp, Artificial Sequence
  Description of Artificial Sequence: Synthetic oligonucleotide
aagagacctggtgggagagc

SEQ ID NO: 9194 - DNA, 20 bp, Artificial Sequence
  Description of Artificial Sequence: Synthetic oligonucleotide
agagacctggtgggagagct

SEQ ID NO: 9195 - DNA, 20 bp, Artificial Sequence
  Description of Artificial Sequence: Synthetic oligonucleotide
gagacctggtgggagagctg

SEQ ID NO: 9196 - DNA, 20 bp, Artificial Sequence
  Description of Artificial Sequence: Synthetic oligonucleotide
agacctggtgggagagctgc

SEQ ID NO: 9197 - DNA, 20 bp, Artificial Sequence
  Description of Artificial Sequence: Synthetic oligonucleotide
gacctggtgggagagctgca

SEQ ID NO: 9198 - DNA, 20 bp, Artificial Sequence
  Description of Artificial Sequence: Synthetic oligonucleotide
acctggtgggagagctgcac

SEQ ID NO: 9199 - DNA, 20 bp, Artificial Sequence
  Description of Artificial Sequence: Synthetic oligonucleotide
cctggtgggagagctgcact

SEQ ID NO: 9200 - DNA, 20 bp, Artificial Sequence
  Description of Artificial Sequence: Synthetic oligonucleotide
ctggtgggagagctgcactt

SEQ ID NO: 9201 - DNA, 20 bp, Artificial Sequence
  Description of Artificial Sequence: Synthetic oligonucleotide
tggtgggagagctgcacttg

SEQ ID NO: 9202 - DNA, 20 bp, Artificial Sequence
  Description of Artificial Sequence: Synthetic oligonucleotide
ggtgggagagctgcacttga

SEQ ID NO: 9203 - DNA, 20 bp, Artificial Sequence
  Description of Artificial Sequence: Synthetic oligonucleotide
gtgggagagctgcacttgac

SEQ ID NO: 9204 - DNA, 20 bp, Artificial Sequence
  Description of Artificial Sequence: Synthetic oligonucleotide
tgggagagctgcacttgacc

SEQ ID NO: 9205 - DNA, 20 bp, Artificial Sequence
  Description of Artificial Sequence: Synthetic oligonucleotide
gggagagctgcacttgaccc

SEQ ID NO: 9206 - DNA, 20 bp, Artificial Sequence
  Description of Artificial Sequence: Synthetic oligonucleotide
ggagagctgcacttgacccc

SEQ ID NO: 9207 - DNA, 20 bp, Artificial Sequence
  Description of Artificial Sequence: Synthetic oligonucleotide
gagagctgcacttgacccca

SEQ ID NO: 9208 - DNA, 20 bp, Artificial Sequence
  Description of Artificial Sequence: Synthetic oligonucleotide
agagctgcacttgaccccaa

SEQ ID NO: 9209 - DNA, 20 bp, Artificial Sequence
  Description of Artificial Sequence: Synthetic oligonucleotide
gagctgcacttgaccccaag

SEQ ID NO: 9210 - DNA, 20 bp, Artificial Sequence
  Description of Artificial Sequence: Synthetic oligonucleotide
agctgcacttgaccccaaga

SEQ ID NO: 9211 - DNA, 20 bp, Artificial Sequence
  Description of Artificial Sequence: Synthetic oligonucleotide
gctgcacttgaccccaagaa

SEQ ID NO: 9212 - DNA, 20 bp, Artificial Sequence
  Description of Artificial Sequence: Synthetic oligonucleotide
ctgcacttgaccccaagaac

SEQ ID NO: 9213 - DNA, 20 bp, Artificial Sequence
  Description of Artificial Sequence: Synthetic oligonucleotide
tgcacttgaccccaagaacc

SEQ ID NO: 9214 - DNA, 20 bp, Artificial Sequence
  Description of Artificial Sequence: Synthetic oligonucleotide
gcacttgaccccaagaacct

SEQ ID NO: 9215 - DNA, 20 bp, Artificial Sequence
  Description of Artificial Sequence: Synthetic oligonucleotide
cacttgaccccaagaacctc

SEQ ID NO: 9216 - DNA, 20 bp, Artificial Sequence
  Description of Artificial Sequence: Synthetic oligonucleotide
acttgaccccaagaacctcc

SEQ ID NO: 9217 - DNA, 20 bp, Artificial Sequence
  Description of Artificial Sequence: Synthetic oligonucleotide
cttgaccccaagaacctcct

SEQ ID NO: 9218 - DNA, 20 bp, Artificial Sequence
  Description of Artificial Sequence: Synthetic oligonucleotide
ttgaccccaagaacctcctt

SEQ ID NO: 9219 - DNA, 20 bp, Artificial Sequence
  Description of Artificial Sequence: Synthetic oligonucleotide
tgaccccaagaacctccttg

SEQ ID NO: 9220 - DNA, 20 bp, Artificial Sequence
  Description of Artificial Sequence: Synthetic oligonucleotide
gaccccaagaacctccttgc

SEQ ID NO: 9221 - DNA, 20 bp, Artificial Sequence
  Description of Artificial Sequence: Synthetic oligonucleotide
accccaagaacctccttgca

SEQ ID NO: 9222 - DNA, 20 bp, Artificial Sequence
  Description of Artificial Sequence: Synthetic oligonucleotide
ccccaagaacctccttgcag

SEQ ID NO: 9223 - DNA, 20 bp, Artificial Sequence
  Description of Artificial Sequence: Synthetic oligonucleotide
cccaagaacctccttgcagg

SEQ ID NO: 9224 - DNA, 20 bp, Artificial Sequence
  Description of Artificial Sequence: Synthetic oligonucleotide
ccaagaacctccttgcagga

SEQ ID NO: 9225 - DNA, 20 bp, Artificial Sequence
  Description of Artificial Sequence: Synthetic oligonucleotide
caagaacctccttgcaggat

SEQ ID NO: 9226 - DNA, 20 bp, Artificial Sequence
  Description of Artificial Sequence: Synthetic oligonucleotide
aagaacctccttgcaggatg

SEQ ID NO: 9227 - DNA, 20 bp, Artificial Sequence
  Description of Artificial Sequence: Synthetic oligonucleotide
agaacctccttgcaggatgg

SEQ ID NO: 9228 - DNA, 20 bp, Artificial Sequence
  Description of Artificial Sequence: Synthetic oligonucleotide
gaacctccttgcaggatggt

SEQ ID NO: 9229 - DNA, 20 bp, Artificial Sequence
  Description of Artificial Sequence: Synthetic oligonucleotide
aacctccttgcaggatggtg

SEQ ID NO: 9230 - DNA, 20 bp, Artificial Sequence
  Description of Artificial Sequence: Synthetic oligonucleotide
acctccttgcaggatggtga

SEQ ID NO: 9231 - DNA, 20 bp, Artificial Sequence
  Description of Artificial Sequence: Synthetic oligonucleotide
cctccttgcaggatggtgag

SEQ ID NO: 9232 - DNA, 20 bp, Artificial Sequence
  Description of Artificial Sequence: Synthetic oligonucleotide
ctccttgcaggatggtgaga

SEQ ID NO: 9233 - DNA, 20 bp, Artificial Sequence
  Description of Artificial Sequence: Synthetic oligonucleotide
tccttgcaggatggtgagaa

SEQ ID NO: 9234 - DNA, 20 bp, Artificial Sequence
  Description of Artificial Sequence: Synthetic oligonucleotide
ccttgcaggatggtgagaaa

SEQ ID NO: 9235 - DNA, 20 bp, Artificial Sequence
  Description of Artificial Sequence: Synthetic oligonucleotide
cttgcaggatggtgagaaag

SEQ ID NO: 9236 - DNA, 20 bp, Artificial Sequence
  Description of Artificial Sequence: Synthetic oligonucleotide
ttgcaggatggtgagaaagc

SEQ ID NO: 9237 - DNA, 20 bp, Artificial Sequence
  Description of Artificial Sequence: Synthetic oligonucleotide
tgcaggatggtgagaaagcc

SEQ ID NO: 9238 - DNA, 20 bp, Artificial Sequence
  Description of Artificial Sequence: Synthetic oligonucleotide
gcaggatggtgagaaagcct

SEQ ID NO: 9239 - DNA, 20 bp, Artificial Sequence
  Description of Artificial Sequence: Synthetic oligonucleotide
caggatggtgagaaagcctc

SEQ ID NO: 9240 - DNA, 20 bp, Artificial Sequence
  Description of Artificial Sequence: Synthetic oligonucleotide
aggatggtgagaaagcctcc

SEQ ID NO: 9241 - DNA, 20 bp, Artificial Sequence
  Description of Artificial Sequence: Synthetic oligonucleotide
ggatggtgagaaagcctcct

SEQ ID NO: 9242 - DNA, 20 bp, Artificial Sequence
  Description of Artificial Sequence: Synthetic oligonucleotide
gatggtgagaaagcctcctg

SEQ ID NO: 9243 - DNA, 20 bp, Artificial Sequence
  Description of Artificial Sequence: Synthetic oligonucleotide
atggtgagaaagcctcctgt

SEQ ID NO: 9244 - DNA, 20 bp, Artificial Sequence
  Description of Artificial Sequence: Synthetic oligonucleotide
tggtgagaaagcctcctgtt

SEQ ID NO: 9245 - DNA, 20 bp, Artificial Sequence
  Description of Artificial Sequence: Synthetic oligonucleotide
ggtgagaaagcctcctgttt

SEQ ID NO: 9246 - DNA, 20 bp, Artificial Sequence
  Description of Artificial Sequence: Synthetic oligonucleotide
gtgagaaagcctcctgtttg

SEQ ID NO: 9247 - DNA, 20 bp, Artificial Sequence
  Description of Artificial Sequence: Synthetic oligonucleotide
tgagaaagcctcctgtttgg

SEQ ID NO: 9248 - DNA, 20 bp, Artificial Sequence
  Description of Artificial Sequence: Synthetic oligonucleotide
gagaaagcctcctgtttgga

SEQ ID NO: 9249 - DNA, 20 bp, Artificial Sequence
  Description of Artificial Sequence: Synthetic oligonucleotide
agaaagcctcctgtttggat

SEQ ID NO: 9250 - DNA, 20 bp, Artificial Sequence
  Description of Artificial Sequence: Synthetic oligonucleotide
gaaagcctcctgtttggatg

SEQ ID NO: 9251 - DNA, 20 bp, Artificial Sequence
  Description of Artificial Sequence: Synthetic oligonucleotide
aaagcctcctgtttggatga

SEQ ID NO: 9252 - DNA, 20 bp, Artificial Sequence
  Description of Artificial Sequence: Synthetic oligonucleotide
aagcctcctgtttggatgag

SEQ ID NO: 9253 - DNA, 20 bp, Artificial Sequence
  Description of Artificial Sequence: Synthetic oligonucleotide
agcctcctgtttggatgagc

SEQ ID NO: 9254 - DNA, 20 bp, Artificial Sequence
  Description of Artificial Sequence: Synthetic oligonucleotide
gcctcctgtttggatgagca

SEQ ID NO: 9255 - DNA, 20 bp, Artificial Sequence
  Description of Artificial Sequence: Synthetic oligonucleotide
cctcctgtttggatgagcag

SEQ ID NO: 9256 - DNA, 20 bp, Artificial Sequence
  Description of Artificial Sequence: Synthetic oligonucleotide
ctcctgtttggatgagcagg

SEQ ID NO: 9257 - DNA, 20 bp, Artificial Sequence
  Description of Artificial Sequence: Synthetic oligonucleotide
tcctgtttggatgagcagga

SEQ ID NO: 9258 - DNA, 20 bp, Artificial Sequence
  Description of Artificial Sequence: Synthetic oligonucleotide
cctgtttggatgagcaggaa

SEQ ID NO: 9259 - DNA, 20 bp, Artificial Sequence
  Description of Artificial Sequence: Synthetic oligonucleotide
ctgtttggatgagcaggaag

SEQ ID NO: 9260 - DNA, 20 bp, Artificial Sequence
  Description of Artificial Sequence: Synthetic oligonucleotide
tgtttggatgagcaggaagt

SEQ ID NO: 9261 - DNA, 20 bp, Artificial Sequence
  Description of Artificial Sequence: Synthetic oligonucleotide
gtttggatgagcaggaagtg

SEQ ID NO: 9262 - DNA, 20 bp, Artificial Sequence
  Description of Artificial Sequence: Synthetic oligonucleotide
tttggatgagcaggaagtgg

SEQ ID NO: 9263 - DNA, 20 bp, Artificial Sequence
  Description of Artificial Sequence: Synthetic oligonucleotide
ttggatgagcaggaagtggc

SEQ ID NO: 9264 - DNA, 20 bp, Artificial Sequence
  Description of Artificial Sequence: Synthetic oligonucleotide
tggatgagcaggaagtggca

SEQ ID NO: 9265 - DNA, 20 bp, Artificial Sequence
  Description of Artificial Sequence: Synthetic oligonucleotide
ggatgagcaggaagtggcac

SEQ ID NO: 9266 - DNA, 20 bp, Artificial Sequence
  Description of Artificial Sequence: Synthetic oligonucleotide
gatgagcaggaagtggcacg

SEQ ID NO: 9267 - DNA, 20 bp, Artificial Sequence
  Description of Artificial Sequence: Synthetic oligonucleotide
atgagcaggaagtggcacgg

SEQ ID NO: 9268 - DNA, 20 bp, Artificial Sequence
  Description of Artificial Sequence: Synthetic oligonucleotide
tgagcaggaagtggcacggt

SEQ ID NO: 9269 - DNA, 20 bp, Artificial Sequence
  Description of Artificial Sequence: Synthetic oligonucleotide
gagcaggaagtggcacggtc

SEQ ID NO: 9270 - DNA, 20 bp, Artificial Sequence
  Description of Artificial Sequence: Synthetic oligonucleotide
agcaggaagtggcacggtca

SEQ ID NO: 9271 - DNA, 20 bp, Artificial Sequence
  Description of Artificial Sequence: Synthetic oligonucleotide
gcaggaagtggcacggtcag

SEQ ID NO: 9272 - DNA, 20 bp, Artificial Sequence
  Description of Artificial Sequence: Synthetic oligonucleotide
caggaagtggcacggtcaga

SEQ ID NO: 9273 - DNA, 20 bp, Artificial Sequence
  Description of Artificial Sequence: Synthetic oligonucleotide
aggaagtggcacggtcagat

SEQ ID NO: 9274 - DNA, 20 bp, Artificial Sequence
  Description of Artificial Sequence: Synthetic oligonucleotide
ggaagtggcacggtcagatt

SEQ ID NO: 9275 - DNA, 20 bp, Artificial Sequence
  Description of Artificial Sequence: Synthetic oligonucleotide
gaagtggcacggtcagattc

SEQ ID NO: 9276 - DNA, 20 bp, Artificial Sequence
  Description of Artificial Sequence: Synthetic oligonucleotide
aagtggcacggtcagattcc

SEQ ID NO: 9277 - DNA, 20 bp, Artificial Sequence
  Description of Artificial Sequence: Synthetic oligonucleotide
agtggcacggtcagattcct

SEQ ID NO: 9278 - DNA, 20 bp, Artificial Sequence
  Description of Artificial Sequence: Synthetic oligonucleotide
gtggcacggtcagattcctc

SEQ ID NO: 9279 - DNA, 20 bp, Artificial Sequence
  Description of Artificial Sequence: Synthetic oligonucleotide
tggcacggtcagattcctct

SEQ ID NO: 9280 - DNA, 20 bp, Artificial Sequence
  Description of Artificial Sequence: Synthetic oligonucleotide
ggcacggtcagattcctctg

SEQ ID NO: 9281 - DNA, 20 bp, Artificial Sequence
  Description of Artificial Sequence: Synthetic oligonucleotide
gcacggtcagattcctctgt

SEQ ID NO: 9282 - DNA, 20 bp, Artificial Sequence
  Description of Artificial Sequence: Synthetic oligonucleotide
cacggtcagattcctctgtc

SEQ ID NO: 9283 - DNA, 20 bp, Artificial Sequence
  Description of Artificial Sequence: Synthetic oligonucleotide
acggtcagattcctctgtct

SEQ ID NO: 9284 - DNA, 20 bp, Artificial Sequence
  Description of Artificial Sequence: Synthetic oligonucleotide
cggtcagattcctctgtctg

SEQ ID NO: 9285 - DNA, 20 bp, Artificial Sequence
  Description of Artificial Sequence: Synthetic oligonucleotide
ggtcagattcctctgtctgg

SEQ ID NO: 9286 - DNA, 20 bp, Artificial Sequence
  Description of Artificial Sequence: Synthetic oligonucleotide
gtcagattcctctgtctggc

SEQ ID NO: 9287 - DNA, 20 bp, Artificial Sequence
  Description of Artificial Sequence: Synthetic oligonucleotide
tcagattcctctgtctggcc

SEQ ID NO: 9288 - DNA, 20 bp, Artificial Sequence
  Description of Artificial Sequence: Synthetic oligonucleotide
cagattcctctgtctggcct

SEQ ID NO: 9289 - DNA, 20 bp, Artificial Sequence
  Description of Artificial Sequence: Synthetic oligonucleotide
agattcctctgtctggcctg

SEQ ID NO: 9290 - DNA, 20 bp, Artificial Sequence
  Description of Artificial Sequence: Synthetic oligonucleotide
gattcctctgtctggcctgg

SEQ ID NO: 9291 - DNA, 20 bp, Artificial Sequence
  Description of Artificial Sequence: Synthetic oligonucleotide
attcctctgtctggcctggt

SEQ ID NO: 9292 - DNA, 20 bp, Artificial Sequence
  Description of Artificial Sequence: Synthetic oligonucleotide
ttcctctgtctggcctggtc

SEQ ID NO: 9293 - DNA, 20 bp, Artificial Sequence
  Description of Artificial Sequence: Synthetic oligonucleotide
tcctctgtctggcctggtct

SEQ ID NO: 9294 - DNA, 20 bp, Artificial Sequence
  Description of Artificial Sequence: Synthetic oligonucleotide
cctctgtctggcctggtctt

SEQ ID NO: 9295 - DNA, 20 bp, Artificial Sequence
  Description of Artificial Sequence: Synthetic oligonucleotide
ctctgtctggcctggtcttc

SEQ ID NO: 9296 - DNA, 20 bp, Artificial Sequence
  Description of Artificial Sequence: Synthetic oligonucleotide
tctgtctggcctggtcttcc

SEQ ID NO: 9297 - DNA, 20 bp, Artificial Sequence
  Description of Artificial Sequence: Synthetic oligonucleotide
ctgtctggcctggtcttccg

SEQ ID NO: 9298 - DNA, 20 bp, Artificial Sequence
  Description of Artificial Sequence: Synthetic oligonucleotide
tgtctggcctggtcttccgc

SEQ ID NO: 9299 - DNA, 20 bp, Artificial Sequence
  Description of Artificial Sequence: Synthetic oligonucleotide
gtctggcctggtcttccgca

SEQ ID NO: 9300 - DNA, 20 bp, Artificial Sequence
  Description of Artificial Sequence: Synthetic oligonucleotide
tctggcctggtcttccgcat

SEQ ID NO: 9301 - DNA, 20 bp, Artificial Sequence
  Description of Artificial Sequence: Synthetic oligonucleotide
ctggcctggtcttccgcatg

SEQ ID NO: 9302 - DNA, 20 bp, Artificial Sequence
  Description of Artificial Sequence: Synthetic oligonucleotide
tggcctggtcttccgcatgt

SEQ ID NO: 9303 - DNA, 20 bp, Artificial Sequence
  Description of Artificial Sequence: Synthetic oligonucleotide
ggcctggtcttccgcatgtc

SEQ ID NO: 9304 - DNA, 20 bp, Artificial Sequence
  Description of Artificial Sequence: Synthetic oligonucleotide
gcctggtcttccgcatgtct

SEQ ID NO: 9305 - DNA, 20 bp, Artificial Sequence
  Description of Artificial Sequence: Synthetic oligonucleotide
cctggtcttccgcatgtctg

SEQ ID NO: 9306 - DNA, 20 bp, Artificial Sequence
  Description of Artificial Sequence: Synthetic oligonucleotide
ctggtcttccgcatgtctgg

SEQ ID NO: 9307 - DNA, 20 bp, Artificial Sequence
  Description of Artificial Sequence: Synthetic oligonucleotide
tggtcttccgcatgtctggt

SEQ ID NO: 9308 - DNA, 20 bp, Artificial Sequence
  Description of Artificial Sequence: Synthetic oligonucleotide
ggtcttccgcatgtctggtt

SEQ ID NO: 9309 - DNA, 20 bp, Artificial Sequence
  Description of Artificial Sequence: Synthetic oligonucleotide
gtcttccgcatgtctggttt

SEQ ID NO: 9310 - DNA, 20 bp, Artificial Sequence
  Description of Artificial Sequence: Synthetic oligonucleotide
tcttccgcatgtctggtttc

SEQ ID NO: 9311 - DNA, 20 bp, Artificial Sequence
  Description of Artificial Sequence: Synthetic oligonucleotide
cttccgcatgtctggtttca

SEQ ID NO: 9312 - DNA, 20 bp, Artificial Sequence
  Description of Artificial Sequence: Synthetic oligonucleotide
ttccgcatgtctggtttcat

SEQ ID NO: 9313 - DNA, 20 bp, Artificial Sequence
  Description of Artificial Sequence: Synthetic oligonucleotide
tccgcatgtctggtttcatc

SEQ ID NO: 9314 - DNA, 20 bp, Artificial Sequence
  Description of Artificial Sequence: Synthetic oligonucleotide
ccgcatgtctggtttcatct

SEQ ID NO: 9315 - DNA, 20 bp, Artificial Sequence
  Description of Artificial Sequence: Synthetic oligonucleotide
cgcatgtctggtttcatctc

SEQ ID NO: 9316 - DNA, 20 bp, Artificial Sequence
  Description of Artificial Sequence: Synthetic oligonucleotide
gcatgtctggtttcatctca

SEQ ID NO: 9317 - DNA, 20 bp, Artificial Sequence
  Description of Artificial Sequence: Synthetic oligonucleotide
catgtctggtttcatctcac

SEQ ID NO: 9318 - DNA, 20 bp, Artificial Sequence
  Description of Artificial Sequence: Synthetic oligonucleotide
atgtctggtttcatctcaca

SEQ ID NO: 9319 - DNA, 20 bp, Artificial Sequence
  Description of Artificial Sequence: Synthetic oligonucleotide
tgtctggtttcatctcacag

SEQ ID NO: 9320 - DNA, 20 bp, Artificial Sequence
  Description of Artificial Sequence: Synthetic oligonucleotide
gtctggtttcatctcacaga

SEQ ID NO: 9321 - DNA, 20 bp, Artificial Sequence
  Description of Artificial Sequence: Synthetic oligonucleotide
tctggtttcatctcacagac

SEQ ID NO: 9322 - DNA, 20 bp, Artificial Sequence
  Description of Artificial Sequence: Synthetic oligonucleotide
ctggtttcatctcacagacc

SEQ ID NO: 9323 - DNA, 20 bp, Artificial Sequence
  Description of Artificial Sequence: Synthetic oligonucleotide
tggtttcatctcacagacca

SEQ ID NO: 9324 - DNA, 20 bp, Artificial Sequence
  Description of Artificial Sequence: Synthetic oligonucleotide
ggtttcatctcacagaccaa

SEQ ID NO: 9325 - DNA, 20 bp, Artificial Sequence
  Description of Artificial Sequence: Synthetic oligonucleotide
gtttcatctcacagaccaaa

SEQ ID NO: 9326 - DNA, 20 bp, Artificial Sequence
  Description of Artificial Sequence: Synthetic oligonucleotide
tttcatctcacagaccaaat

SEQ ID NO: 9327 - DNA, 20 bp, Artificial Sequence
  Description of Artificial Sequence: Synthetic oligonucleotide
ttcatctcacagaccaaatc

SEQ ID NO: 9328 - DNA, 20 bp, Artificial Sequence
  Description of Artificial Sequence: Synthetic oligonucleotide
tcatctcacagaccaaatca

SEQ ID NO: 9329 - DNA, 20 bp, Artificial Sequence
  Description of Artificial Sequence: Synthetic oligonucleotide
catctcacagaccaaatcag

SEQ ID NO: 9330 - DNA, 20 bp, Artificial Sequence
  Description of Artificial Sequence: Synthetic oligonucleotide
atctcacagaccaaatcagg

SEQ ID NO: 9331 - DNA, 20 bp, Artificial Sequence
  Description of Artificial Sequence: Synthetic oligonucleotide
tctcacagaccaaatcagga

SEQ ID NO: 9332 - DNA, 20 bp, Artificial Sequence
  Description of Artificial Sequence: Synthetic oligonucleotide
ctcacagaccaaatcaggac

SEQ ID NO: 9333 - DNA, 20 bp, Artificial Sequence
  Description of Artificial Sequence: Synthetic oligonucleotide
tcacagaccaaatcaggact

SEQ ID NO: 9334 - DNA, 20 bp, Artificial Sequence
  Description of Artificial Sequence: Synthetic oligonucleotide
cacagaccaaatcaggactc

SEQ ID NO: 9335 - DNA, 20 bp, Artificial Sequence
  Description of Artificial Sequence: Synthetic oligonucleotide
acagaccaaatcaggactca

SEQ ID NO: 9336 - DNA, 20 bp, Artificial Sequence
  Description of Artificial Sequence: Synthetic oligonucleotide
cagaccaaatcaggactcac

SEQ ID NO: 9337 - DNA, 20 bp, Artificial Sequence
  Description of Artificial Sequence: Synthetic oligonucleotide
agaccaaatcaggactcact

SEQ ID NO: 9338 - DNA, 20 bp, Artificial Sequence
  Description of Artificial Sequence: Synthetic oligonucleotide
gaccaaatcaggactcactt

SEQ ID NO: 9339 - DNA, 20 bp, Artificial Sequence
  Description of Artificial Sequence: Synthetic oligonucleotide
accaaatcaggactcacttg

SEQ ID NO: 9340 - DNA, 20 bp, Artificial Sequence
  Description of Artificial Sequence: Synthetic oligonucleotide
ccaaatcaggactcacttgt

SEQ ID NO: 9341 - DNA, 20 bp, Artificial Sequence
  Description of Artificial Sequence: Synthetic oligonucleotide
caaatcaggactcacttgtc

SEQ ID NO: 9342 - DNA, 20 bp, Artificial Sequence
  Description of Artificial Sequence: Synthetic oligonucleotide
aaatcaggactcacttgtct

SEQ ID NO: 9343 - DNA, 20 bp, Artificial Sequence
  Description of Artificial Sequence: Synthetic oligonucleotide
aatcaggactcacttgtctg

SEQ ID NO: 9344 - DNA, 20 bp, Artificial Sequence
  Description of Artificial Sequence: Synthetic oligonucleotide
atcaggactcacttgtctgg

SEQ ID NO: 9345 - DNA, 20 bp, Artificial Sequence
  Description of Artificial Sequence: Synthetic oligonucleotide
tcaggactcacttgtctgga

SEQ ID NO: 9346 - DNA, 20 bp, Artificial Sequence
  Description of Artificial Sequence: Synthetic oligonucleotide
caggactcacttgtctggaa

SEQ ID NO: 9347 - DNA, 20 bp, Artificial Sequence
  Description of Artificial Sequence: Synthetic oligonucleotide
aggactcacttgtctggaaa

SEQ ID NO: 9348 - DNA, 20 bp, Artificial Sequence
  Description of Artificial Sequence: Synthetic oligonucleotide
ggactcacttgtctggaaaa

SEQ ID NO: 9349 - DNA, 20 bp, Artificial Sequence
  Description of Artificial Sequence: Synthetic oligonucleotide
gactcacttgtctggaaaat

SEQ ID NO: 9350 - DNA, 20 bp, Artificial Sequence
  Description of Artificial Sequence: Synthetic oligonucleotide
actcacttgtctggaaaatg

SEQ ID NO: 9351 - DNA, 20 bp, Artificial Sequence
  Description of Artificial Sequence: Synthetic oligonucleotide
ctcacttgtctggaaaatgg

SEQ ID NO: 9352 - DNA, 20 bp, Artificial Sequence
  Description of Artificial Sequence: Synthetic oligonucleotide
tcacttgtctggaaaatggc

SEQ ID NO: 9353 - DNA, 20 bp, Artificial Sequence
  Description of Artificial Sequence: Synthetic oligonucleotide
cacttgtctggaaaatggcc

SEQ ID NO: 9354 - DNA, 20 bp, Artificial Sequence
  Description of Artificial Sequence: Synthetic oligonucleotide
acttgtctggaaaatggcct

SEQ ID NO: 9355 - DNA, 20 bp, Artificial Sequence
  Description of Artificial Sequence: Synthetic oligonucleotide
cttgtctggaaaatggcctg

SEQ ID NO: 9356 - DNA, 20 bp, Artificial Sequence
  Description of Artificial Sequence: Synthetic oligonucleotide
ttgtctggaaaatggcctga

SEQ ID NO: 9357 - DNA, 20 bp, Artificial Sequence
  Description of Artificial Sequence: Synthetic oligonucleotide
tgtctggaaaatggcctgag

SEQ ID NO: 9358 - DNA, 20 bp, Artificial Sequence
  Description of Artificial Sequence: Synthetic oligonucleotide
gtctggaaaatggcctgaga

SEQ ID NO: 9359 - DNA, 20 bp, Artificial Sequence
  Description of Artificial Sequence: Synthetic oligonucleotide
tctggaaaatggcctgagaa

SEQ ID NO: 9360 - DNA, 20 bp, Artificial Sequence
  Description of Artificial Sequence: Synthetic oligonucleotide
ctggaaaatggcctgagaat

SEQ ID NO: 9361 - DNA, 20 bp, Artificial Sequence
  Description of Artificial Sequence: Synthetic oligonucleotide
tggaaaatggcctgagaata

SEQ ID NO: 9362 - DNA, 20 bp, Artificial Sequence
  Description of Artificial Sequence: Synthetic oligonucleotide
ggaaaatggcctgagaatac

SEQ ID NO: 9363 - DNA, 20 bp, Artificial Sequence
  Description of Artificial Sequence: Synthetic oligonucleotide
gaaaatggcctgagaatacc

SEQ ID NO: 9364 - DNA, 20 bp, Artificial Sequence
  Description of Artificial Sequence: Synthetic oligonucleotide
aaaatggcctgagaatacct

SEQ ID NO: 9365 - DNA, 20 bp, Artificial Sequence
  Description of Artificial Sequence: Synthetic oligonucleotide
aaatggcctgagaatacctt

SEQ ID NO: 9366 - DNA, 20 bp, Artificial Sequence
  Description of Artificial Sequence: Synthetic oligonucleotide
aatggcctgagaataccttt

SEQ ID NO: 9367 - DNA, 20 bp, Artificial Sequence
  Description of Artificial Sequence: Synthetic oligonucleotide
atggcctgagaatacctttc

SEQ ID NO: 9368 - DNA, 20 bp, Artificial Sequence
  Description of Artificial Sequence: Synthetic oligonucleotide
tggcctgagaatacctttct

SEQ ID NO: 9369 - DNA, 20 bp, Artificial Sequence
  Description of Artificial Sequence: Synthetic oligonucleotide
ggcctgagaatacctttcta

SEQ ID NO: 9370 - DNA, 20 bp, Artificial Sequence
  Description of Artificial Sequence: Synthetic oligonucleotide
gcctgagaatacctttctaa

SEQ ID NO: 9371 - DNA, 20 bp, Artificial Sequence
  Description of Artificial Sequence: Synthetic oligonucleotide
cctgagaatacctttctaat

SEQ ID NO: 9372 - DNA, 20 bp, Artificial Sequence
  Description of Artificial Sequence: Synthetic oligonucleotide
ctgagaatacctttctaatc

SEQ ID NO: 9373 - DNA, 20 bp, Artificial Sequence
  Description of Artificial Sequence: Synthetic oligonucleotide
tgagaatacctttctaatcc

SEQ ID NO: 9374 - DNA, 20 bp, Artificial Sequence
  Description of Artificial Sequence: Synthetic oligonucleotide
gagaatacctttctaatccc

SEQ ID NO: 9375 - DNA, 20 bp, Artificial Sequence
  Description of Artificial Sequence: Synthetic oligonucleotide
agaatacctttctaatccca

SEQ ID NO: 9376 - DNA, 20 bp, Artificial Sequence
  Description of Artificial Sequence: Synthetic oligonucleotide
gaatacctttctaatcccaa

SEQ ID NO: 9377 - DNA, 20 bp, Artificial Sequence
  Description of Artificial Sequence: Synthetic oligonucleotide
aatacctttctaatcccaaa

SEQ ID NO: 9378 - DNA, 20 bp, Artificial Sequence
  Description of Artificial Sequence: Synthetic oligonucleotide
atacctttctaatcccaaac

SEQ ID NO: 9379 - DNA, 20 bp, Artificial Sequence
  Description of Artificial Sequence: Synthetic oligonucleotide
tacctttctaatcccaaact

SEQ ID NO: 9380 - DNA, 20 bp, Artificial Sequence
  Description of Artificial Sequence: Synthetic oligonucleotide
acctttctaatcccaaactg

SEQ ID NO: 9381 - DNA, 20 bp, Artificial Sequence
  Description of Artificial Sequence: Synthetic oligonucleotide
cctttctaatcccaaactga

SEQ ID NO: 9382 - DNA, 20 bp, Artificial Sequence
  Description of Artificial Sequence: Synthetic oligonucleotide
ctttctaatcccaaactgag

SEQ ID NO: 9383 - DNA, 20 bp, Artificial Sequence
  Description of Artificial Sequence: Synthetic oligonucleotide
tttctaatcccaaactgagg

SEQ ID NO: 9384 - DNA, 20 bp, Artificial Sequence
  Description of Artificial Sequence: Synthetic oligonucleotide
ttctaatcccaaactgaggg

SEQ ID NO: 9385 - DNA, 20 bp, Artificial Sequence
  Description of Artificial Sequence: Synthetic oligonucleotide
tctaatcccaaactgagggc

SEQ ID NO: 9386 - DNA, 20 bp, Artificial Sequence
  Description of Artificial Sequence: Synthetic oligonucleotide
ctaatcccaaactgagggcc

SEQ ID NO: 9387 - DNA, 20 bp, Artificial Sequence
  Description of Artificial Sequence: Synthetic oligonucleotide
taatcccaaactgagggccc

SEQ ID NO: 9388 - DNA, 20 bp, Artificial Sequence
  Description of Artificial Sequence: Synthetic oligonucleotide
aatcccaaactgagggcccg

SEQ ID NO: 9389 - DNA, 20 bp, Artificial Sequence
  Description of Artificial Sequence: Synthetic oligonucleotide
atcccaaactgagggcccgg

SEQ ID NO: 9390 - DNA, 20 bp, Artificial Sequence
  Description of Artificial Sequence: Synthetic oligonucleotide
tcccaaactgagggcccgga

SEQ ID NO: 9391 - DNA, 20 bp, Artificial Sequence
  Description of Artificial Sequence: Synthetic oligonucleotide
cccaaactgagggcccggaa

SEQ ID NO: 9392 - DNA, 20 bp, Artificial Sequence
  Description of Artificial Sequence: Synthetic oligonucleotide
ccaaactgagggcccggaag

SEQ ID NO: 9393 - DNA, 20 bp, Artificial Sequence
  Description of Artificial Sequence: Synthetic oligonucleotide
caaactgagggcccggaagt

SEQ ID NO: 9394 - DNA, 20 bp, Artificial Sequence
  Description of Artificial Sequence: Synthetic oligonucleotide
aaactgagggcccggaagtc

SEQ ID NO: 9395 - DNA, 20 bp, Artificial Sequence
  Description of Artificial Sequence: Synthetic oligonucleotide
aactgagggcccggaagtcc

SEQ ID NO: 9396 - DNA, 20 bp, Artificial Sequence
  Description of Artificial Sequence: Synthetic oligonucleotide
actgagggcccggaagtcca

SEQ ID NO: 9397 - DNA, 20 bp, Artificial Sequence
  Description of Artificial Sequence: Synthetic oligonucleotide
ctgagggcccggaagtccat

SEQ ID NO: 9398 - DNA, 20 bp, Artificial Sequence
  Description of Artificial Sequence: Synthetic oligonucleotide
tgagggcccggaagtccatg

SEQ ID NO: 9399 - DNA, 20 bp, Artificial Sequence
  Description of Artificial Sequence: Synthetic oligonucleotide
gagggcccggaagtccatgc

SEQ ID NO: 9400 - DNA, 20 bp, Artificial Sequence
  Description of Artificial Sequence: Synthetic oligonucleotide
agggcccggaagtccatgct

SEQ ID NO: 9401 - DNA, 20 bp, Artificial Sequence
  Description of Artificial Sequence: Synthetic oligonucleotide
gggcccggaagtccatgctt

SEQ ID NO: 9402 - DNA, 20 bp, Artificial Sequence
  Description of Artificial Sequence: Synthetic oligonucleotide
ggcccggaagtccatgctta

SEQ ID NO: 9403 - DNA, 20 bp, Artificial Sequence
  Description of Artificial Sequence: Synthetic oligonucleotide
gcccggaagtccatgcttag

SEQ ID NO: 9404 - DNA, 20 bp, Artificial Sequence
  Description of Artificial Sequence: Synthetic oligonucleotide
cccggaagtccatgcttaga

SEQ ID NO: 9405 - DNA, 20 bp, Artificial Sequence
  Description of Artificial Sequence: Synthetic oligonucleotide
ccggaagtccatgcttagaa

SEQ ID NO: 9406 - DNA, 20 bp, Artificial Sequence
  Description of Artificial Sequence: Synthetic oligonucleotide
cggaagtccatgcttagaaa

SEQ ID NO: 9407 - DNA, 20 bp, Artificial Sequence
  Description of Artificial Sequence: Synthetic oligonucleotide
ggaagtccatgcttagaaag

SEQ ID NO: 9408 - DNA, 20 bp, Artificial Sequence
  Description of Artificial Sequence: Synthetic oligonucleotide
gaagtccatgcttagaaagt

SEQ ID NO: 9409 - DNA, 20 bp, Artificial Sequence
  Description of Artificial Sequence: Synthetic oligonucleotide
aagtccatgcttagaaagtg

SEQ ID NO: 9410 - DNA, 20 bp, Artificial Sequence
  Description of Artificial Sequence: Synthetic oligonucleotide
agtccatgcttagaaagtga

SEQ ID NO: 9411 - DNA, 20 bp, Artificial Sequence
  Description of Artificial Sequence: Synthetic oligonucleotide
gtccatgcttagaaagtgat

SEQ ID NO: 9412 - DNA, 20 bp, Artificial Sequence
  Description of Artificial Sequence: Synthetic oligonucleotide
tccatgcttagaaagtgatt

SEQ ID NO: 9413 - DNA, 20 bp, Artificial Sequence
  Description of Artificial Sequence: Synthetic oligonucleotide
ccatgcttagaaagtgattg

SEQ ID NO: 9414 - DNA, 20 bp, Artificial Sequence
  Description of Artificial Sequence: Synthetic oligonucleotide
catgcttagaaagtgattga

SEQ ID NO: 9415 - DNA, 20 bp, Artificial Sequence
  Description of Artificial Sequence: Synthetic oligonucleotide
atgcttagaaagtgattgat

SEQ ID NO: 9416 - DNA, 20 bp, Artificial Sequence
  Description of Artificial Sequence: Synthetic oligonucleotide
tgcttagaaagtgattgata

SEQ ID NO: 9417 - DNA, 20 bp, Artificial Sequence
  Description of Artificial Sequence: Synthetic oligonucleotide
gcttagaaagtgattgatac

SEQ ID NO: 9418 - DNA, 20 bp, Artificial Sequence
  Description of Artificial Sequence: Synthetic oligonucleotide
cttagaaagtgattgataca

SEQ ID NO: 9419 - DNA, 20 bp, Artificial Sequence
  Description of Artificial Sequence: Synthetic oligonucleotide
ttagaaagtgattgatacat

SEQ ID NO: 9420 - DNA, 20 bp, Artificial Sequence
  Description of Artificial Sequence: Synthetic oligonucleotide
tagaaagtgattgatacatg

SEQ ID NO: 9421 - DNA, 20 bp, Artificial Sequence
  Description of Artificial Sequence: Synthetic oligonucleotide
agaaagtgattgatacatgt

SEQ ID NO: 9422 - DNA, 20 bp, Artificial Sequence
  Description of Artificial Sequence: Synthetic oligonucleotide
gaaagtgattgatacatgtt

SEQ ID NO: 9423 - DNA, 20 bp, Artificial Sequence
  Description of Artificial Sequence: Synthetic oligonucleotide
aaagtgattgatacatgttg

SEQ ID NO: 9424 - DNA, 20 bp, Artificial Sequence
  Description of Artificial Sequence: Synthetic oligonucleotide
aagtgattgatacatgttgg

SEQ ID NO: 9425 - DNA, 20 bp, Artificial Sequence
  Description of Artificial Sequence: Synthetic oligonucleotide
agtgattgatacatgttggt

SEQ ID NO: 9426 - DNA, 20 bp, Artificial Sequence
  Description of Artificial Sequence: Synthetic oligonucleotide
gtgattgatacatgttggtt

SEQ ID NO: 9427 - DNA, 20 bp, Artificial Sequence
  Description of Artificial Sequence: Synthetic oligonucleotide
tgattgatacatgttggttc

SEQ ID NO: 9428 - DNA, 20 bp, Artificial Sequence
  Description of Artificial Sequence: Synthetic oligonucleotide
gattgatacatgttggttca

SEQ ID NO: 9429 - DNA, 20 bp, Artificial Sequence
  Description of Artificial Sequence: Synthetic oligonucleotide
attgatacatgttggttcag

SEQ ID NO: 9430 - DNA, 20 bp, Artificial Sequence
  Description of Artificial Sequence: Synthetic oligonucleotide
ttgatacatgttggttcagg

SEQ ID NO: 9431 - DNA, 20 bp, Artificial Sequence
  Description of Artificial Sequence: Synthetic oligonucleotide
tgatacatgttggttcaggt

SEQ ID NO: 9432 - DNA, 20 bp, Artificial Sequence
  Description of Artificial Sequence: Synthetic oligonucleotide
gatacatgttggttcaggta

SEQ ID NO: 9433 - DNA, 20 bp, Artificial Sequence
  Description of Artificial Sequence: Synthetic oligonucleotide
atacatgttggttcaggtaa

SEQ ID NO: 9434 - DNA, 20 bp, Artificial Sequence
  Description of Artificial Sequence: Synthetic oligonucleotide
tacatgttggttcaggtaac

SEQ ID NO: 9435 - DNA, 20 bp, Artificial Sequence
  Description of Artificial Sequence: Synthetic oligonucleotide
acatgttggttcaggtaaca

SEQ ID NO: 9436 - DNA, 20 bp, Artificial Sequence
  Description of Artificial Sequence: Synthetic oligonucleotide
catgttggttcaggtaacag

SEQ ID NO: 9437 - DNA, 20 bp, Artificial Sequence
  Description of Artificial Sequence: Synthetic oligonucleotide
atgttggttcaggtaacaga

SEQ ID NO: 9438 - DNA, 20 bp, Artificial Sequence
  Description of Artificial Sequence: Synthetic oligonucleotide
tgttggttcaggtaacagaa

SEQ ID NO: 9439 - DNA, 20 bp, Artificial Sequence
  Description of Artificial Sequence: Synthetic oligonucleotide
gttggttcaggtaacagaat

SEQ ID NO: 9440 - DNA, 20 bp, Artificial Sequence
  Description of Artificial Sequence: Synthetic oligonucleotide
ttggttcaggtaacagaatt

SEQ ID NO: 9441 - DNA, 20 bp, Artificial Sequence
  Description of Artificial Sequence: Synthetic oligonucleotide
tggttcaggtaacagaattt

SEQ ID NO: 9442 - DNA, 20 bp, Artificial Sequence
  Description of Artificial Sequence: Synthetic oligonucleotide
ggttcaggtaacagaatttt

SEQ ID NO: 9443 - DNA, 20 bp, Artificial Sequence
  Description of Artificial Sequence: Synthetic oligonucleotide
gttcaggtaacagaattttc

SEQ ID NO: 9444 - DNA, 20 bp, Artificial Sequence
  Description of Artificial Sequence: Synthetic oligonucleotide
ttcaggtaacagaattttca

SEQ ID NO: 9445 - DNA, 20 bp, Artificial Sequence
  Description of Artificial Sequence: Synthetic oligonucleotide
tcaggtaacagaattttcaa

SEQ ID NO: 9446 - DNA, 20 bp, Artificial Sequence
  Description of Artificial Sequence: Synthetic oligonucleotide
caggtaacagaattttcaag

SEQ ID NO: 9447 - DNA, 20 bp, Artificial Sequence
  Description of Artificial Sequence: Synthetic oligonucleotide
aggtaacagaattttcaagc

SEQ ID NO: 9448 - DNA, 20 bp, Artificial Sequence
  Description of Artificial Sequence: Synthetic oligonucleotide
ggtaacagaattttcaagct

SEQ ID NO: 9449 - DNA, 20 bp, Artificial Sequence
  Description of Artificial Sequence: Synthetic oligonucleotide
gtaacagaattttcaagctt

SEQ ID NO: 9450 - DNA, 20 bp, Artificial Sequence
  Description of Artificial Sequence: Synthetic oligonucleotide
taacagaattttcaagcttg

SEQ ID NO: 9451 - DNA, 20 bp, Artificial Sequence
  Description of Artificial Sequence: Synthetic oligonucleotide
aacagaattttcaagcttgg

SEQ ID NO: 9452 - DNA, 20 bp, Artificial Sequence
  Description of Artificial Sequence: Synthetic oligonucleotide
acagaattttcaagcttggt

SEQ ID NO: 9453 - DNA, 20 bp, Artificial Sequence
  Description of Artificial Sequence: Synthetic oligonucleotide
cagaattttcaagcttggtt

SEQ ID NO: 9454 - DNA, 20 bp, Artificial Sequence
  Description of Artificial Sequence: Synthetic oligonucleotide
agaattttcaagcttggttt

SEQ ID NO: 9455 - DNA, 20 bp, Artificial Sequence
  Description of Artificial Sequence: Synthetic oligonucleotide
gaattttcaagcttggtttc

SEQ ID NO: 9456 - DNA, 20 bp, Artificial Sequence
  Description of Artificial Sequence: Synthetic oligonucleotide
aattttcaagcttggtttca

SEQ ID NO: 9457 - DNA, 20 bp, Artificial Sequence
  Description of Artificial Sequence: Synthetic oligonucleotide
attttcaagcttggtttcat

SEQ ID NO: 9458 - DNA, 20 bp, Artificial Sequence
  Description of Artificial Sequence: Synthetic oligonucleotide
ttttcaagcttggtttcatg

SEQ ID NO: 9459 - DNA, 20 bp, Artificial Sequence
  Description of Artificial Sequence: Synthetic oligonucleotide
tttcaagcttggtttcatgt

SEQ ID NO: 9460 - DNA, 20 bp, Artificial Sequence
  Description of Artificial Sequence: Synthetic oligonucleotide
ttcaagcttggtttcatgtt

SEQ ID NO: 9461 - DNA, 20 bp, Artificial Sequence
  Description of Artificial Sequence: Synthetic oligonucleotide
tcaagcttggtttcatgtta

SEQ ID NO: 9462 - DNA, 20 bp, Artificial Sequence
  Description of Artificial Sequence: Synthetic oligonucleotide
caagcttggtttcatgttaa

SEQ ID NO: 9463 - DNA, 20 bp, Artificial Sequence
  Description of Artificial Sequence: Synthetic oligonucleotide
aagcttggtttcatgttaaa

SEQ ID NO: 9464 - DNA, 20 bp, Artificial Sequence
  Description of Artificial Sequence: Synthetic oligonucleotide
agcttggtttcatgttaaaa

SEQ ID NO: 9465 - DNA, 20 bp, Artificial Sequence
  Description of Artificial Sequence: Synthetic oligonucleotide
gcttggtttcatgttaaaac

SEQ ID NO: 9466 - DNA, 20 bp, Artificial Sequence
  Description of Artificial Sequence: Synthetic oligonucleotide
cttggtttcatgttaaaact

SEQ ID NO: 9467 - DNA, 20 bp, Artificial Sequence
  Description of Artificial Sequence: Synthetic oligonucleotide
ttggtttcatgttaaaactt

SEQ ID NO: 9468 - DNA, 20 bp, Artificial Sequence
  Description of Artificial Sequence: Synthetic oligonucleotide
tggtttcatgttaaaacttt

SEQ ID NO: 9469 - DNA, 20 bp, Artificial Sequence
  Description of Artificial Sequence: Synthetic oligonucleotide
ggtttcatgttaaaactttt

SEQ ID NO: 9470 - DNA, 20 bp, Artificial Sequence
  Description of Artificial Sequence: Synthetic oligonucleotide
gtttcatgttaaaacttttt

SEQ ID NO: 9471 - DNA, 20 bp, Artificial Sequence
  Description of Artificial Sequence: Synthetic oligonucleotide
tttcatgttaaaactttttc

SEQ ID NO: 9472 - DNA, 20 bp, Artificial Sequence
  Description of Artificial Sequence: Synthetic oligonucleotide
ttcatgttaaaactttttct

SEQ ID NO: 9473 - DNA, 20 bp, Artificial Sequence
  Description of Artificial Sequence: Synthetic oligonucleotide
tcatgttaaaactttttctt

SEQ ID NO: 9474 - DNA, 20 bp, Artificial Sequence
  Description of Artificial Sequence: Synthetic oligonucleotide
catgttaaaactttttctta

SEQ ID NO: 9475 - DNA, 20 bp, Artificial Sequence
  Description of Artificial Sequence: Synthetic oligonucleotide
atgttaaaactttttcttaa

SEQ ID NO: 9476 - DNA, 20 bp, Artificial Sequence
  Description of Artificial Sequence: Synthetic oligonucleotide
tgttaaaactttttcttaat

SEQ ID NO: 9477 - DNA, 20 bp, Artificial Sequence
  Description of Artificial Sequence: Synthetic oligonucleotide
gttaaaactttttcttaatt

SEQ ID NO: 9478 - DNA, 20 bp, Artificial Sequence
  Description of Artificial Sequence: Synthetic oligonucleotide
ttaaaactttttcttaattt

SEQ ID NO: 9479 - DNA, 20 bp, Artificial Sequence
  Description of Artificial Sequence: Synthetic oligonucleotide
taaaactttttcttaatttg

SEQ ID NO: 9480 - DNA, 20 bp, Artificial Sequence
  Description of Artificial Sequence: Synthetic oligonucleotide
aaaactttttcttaatttga

SEQ ID NO: 9481 - DNA, 20 bp, Artificial Sequence
  Description of Artificial Sequence: Synthetic oligonucleotide
aaactttttcttaatttgag

SEQ ID NO: 9482 - DNA, 20 bp, Artificial Sequence
  Description of Artificial Sequence: Synthetic oligonucleotide
aactttttcttaatttgagc

SEQ ID NO: 9483 - DNA, 20 bp, Artificial Sequence
  Description of Artificial Sequence: Synthetic oligonucleotide
actttttcttaatttgagct

SEQ ID NO: 9484 - DNA, 20 bp, Artificial Sequence
  Description of Artificial Sequence: Synthetic oligonucleotide
ctttttcttaatttgagctg

SEQ ID NO: 9485 - DNA, 20 bp, Artificial Sequence
  Description of Artificial Sequence: Synthetic oligonucleotide
tttttcttaatttgagctga

SEQ ID NO: 9486 - DNA, 20 bp, Artificial Sequence
  Description of Artificial Sequence: Synthetic oligonucleotide
ttttcttaatttgagctgag

SEQ ID NO: 9487 - DNA, 20 bp, Artificial Sequence
  Description of Artificial Sequence: Synthetic oligonucleotide
tttcttaatttgagctgagg

SEQ ID NO: 9488 - DNA, 20 bp, Artificial Sequence
  Description of Artificial Sequence: Synthetic oligonucleotide
ttcttaatttgagctgaggt

SEQ ID NO: 9489 - DNA, 20 bp, Artificial Sequence
  Description of Artificial Sequence: Synthetic oligonucleotide
tcttaatttgagctgaggtt

SEQ ID NO: 9490 - DNA, 20 bp, Artificial Sequence
  Description of Artificial Sequence: Synthetic oligonucleotide
cttaatttgagctgaggtta

SEQ ID NO: 9491 - DNA, 20 bp, Artificial Sequence
  Description of Artificial Sequence: Synthetic oligonucleotide
ttaatttgagctgaggttaa

SEQ ID NO: 9492 - DNA, 20 bp, Artificial Sequence
  Description of Artificial Sequence: Synthetic oligonucleotide
taatttgagctgaggttaac

SEQ ID NO: 9493 - DNA, 20 bp, Artificial Sequence
  Description of Artificial Sequence: Synthetic oligonucleotide
aatttgagctgaggttaacc

SEQ ID NO: 9494 - DNA, 20 bp, Artificial Sequence
  Description of Artificial Sequence: Synthetic oligonucleotide
atttgagctgaggttaacca

SEQ ID NO: 9495 - DNA, 20 bp, Artificial Sequence
  Description of Artificial Sequence: Synthetic oligonucleotide
tttgagctgaggttaaccat

SEQ ID NO: 9496 - DNA, 20 bp, Artificial Sequence
  Description of Artificial Sequence: Synthetic oligonucleotide
ttgagctgaggttaaccatt

SEQ ID NO: 9497 - DNA, 20 bp, Artificial Sequence
  Description of Artificial Sequence: Synthetic oligonucleotide
tgagctgaggttaaccattg

SEQ ID NO: 9498 - DNA, 20 bp, Artificial Sequence
  Description of Artificial Sequence: Synthetic oligonucleotide
gagctgaggttaaccattga

SEQ ID NO: 9499 - DNA, 20 bp, Artificial Sequence
  Description of Artificial Sequence: Synthetic oligonucleotide
agctgaggttaaccattgac

SEQ ID NO: 9500 - DNA, 20 bp, Artificial Sequence
  Description of Artificial Sequence: Synthetic oligonucleotide
gctgaggttaaccattgact

SEQ ID NO: 9501 - DNA, 20 bp, Artificial Sequence
  Description of Artificial Sequence: Synthetic oligonucleotide
ctgaggttaaccattgactt

SEQ ID NO: 9502 - DNA, 20 bp, Artificial Sequence
  Description of Artificial Sequence: Synthetic oligonucleotide
tgaggttaaccattgactta

SEQ ID NO: 9503 - DNA, 20 bp, Artificial Sequence
  Description of Artificial Sequence: Synthetic oligonucleotide
gaggttaaccattgacttag

SEQ ID NO: 9504 - DNA, 20 bp, Artificial Sequence
  Description of Artificial Sequence: Synthetic oligonucleotide
aggttaaccattgacttagt

SEQ ID NO: 9505 - DNA, 20 bp, Artificial Sequence
  Description of Artificial Sequence: Synthetic oligonucleotide
ggttaaccattgacttagtc

SEQ ID NO: 9506 - DNA, 20 bp, Artificial Sequence
  Description of Artificial Sequence: Synthetic oligonucleotide
gttaaccattgacttagtca

SEQ ID NO: 9507 - DNA, 20 bp, Artificial Sequence
  Description of Artificial Sequence: Synthetic oligonucleotide
ttaaccattgacttagtcag

SEQ ID NO: 9508 - DNA, 20 bp, Artificial Sequence
  Description of Artificial Sequence: Synthetic oligonucleotide
taaccattgacttagtcagt

SEQ ID NO: 9509 - DNA, 20 bp, Artificial Sequence
  Description of Artificial Sequence: Synthetic oligonucleotide
aaccattgacttagtcagta

SEQ ID NO: 9510 - DNA, 20 bp, Artificial Sequence
  Description of Artificial Sequence: Synthetic oligonucleotide
accattgacttagtcagtag

SEQ ID NO: 9511 - DNA, 20 bp, Artificial Sequence
  Description of Artificial Sequence: Synthetic oligonucleotide
ccattgacttagtcagtaga

SEQ ID NO: 9512 - DNA, 20 bp, Artificial Sequence
  Description of Artificial Sequence: Synthetic oligonucleotide
cattgacttagtcagtagaa

SEQ ID NO: 9513 - DNA, 20 bp, Artificial Sequence
  Description of Artificial Sequence: Synthetic oligonucleotide
attgacttagtcagtagaag

SEQ ID NO: 9514 - DNA, 20 bp, Artificial Sequence
  Description of Artificial Sequence: Synthetic oligonucleotide
ttgacttagtcagtagaagc

SEQ ID NO: 9515 - DNA, 20 bp, Artificial Sequence
  Description of Artificial Sequence: Synthetic oligonucleotide
tgacttagtcagtagaagct

SEQ ID NO: 9516 - DNA, 20 bp, Artificial Sequence
  Description of Artificial Sequence: Synthetic oligonucleotide
gacttagtcagtagaagctg

SEQ ID NO: 9517 - DNA, 20 bp, Artificial Sequence
  Description of Artificial Sequence: Synthetic oligonucleotide
acttagtcagtagaagctga

SEQ ID NO: 9518 - DNA, 20 bp, Artificial Sequence
  Description of Artificial Sequence: Synthetic oligonucleotide
cttagtcagtagaagctgat

SEQ ID NO: 9519 - DNA, 20 bp, Artificial Sequence
  Description of Artificial Sequence: Synthetic oligonucleotide
ttagtcagtagaagctgatc

SEQ ID NO: 9520 - DNA, 20 bp, Artificial Sequence
  Description of Artificial Sequence: Synthetic oligonucleotide
tagtcagtagaagctgatca

SEQ ID NO: 9521 - DNA, 20 bp, Artificial Sequence
  Description of Artificial Sequence: Synthetic oligonucleotide
agtcagtagaagctgatcat

SEQ ID NO: 9522 - DNA, 20 bp, Artificial Sequence
  Description of Artificial Sequence: Synthetic oligonucleotide
gtcagtagaagctgatcatg

SEQ ID NO: 9523 - DNA, 20 bp, Artificial Sequence
  Description of Artificial Sequence: Synthetic oligonucleotide
tcagtagaagctgatcatgt

SEQ ID NO: 9524 - DNA, 20 bp, Artificial Sequence
  Description of Artificial Sequence: Synthetic oligonucleotide
cagtagaagctgatcatgtc

SEQ ID NO: 9525 - DNA, 20 bp, Artificial Sequence
  Description of Artificial Sequence: Synthetic oligonucleotide
agtagaagctgatcatgtct

SEQ ID NO: 9526 - DNA, 20 bp, Artificial Sequence
  Description of Artificial Sequence: Synthetic oligonucleotide
gtagaagctgatcatgtctt

SEQ ID NO: 9527 - DNA, 20 bp, Artificial Sequence
  Description of Artificial Sequence: Synthetic oligonucleotide
tagaagctgatcatgtcttt

SEQ ID NO: 9528 - DNA, 20 bp, Artificial Sequence
  Description of Artificial Sequence: Synthetic oligonucleotide
agaagctgatcatgtctttg

SEQ ID NO: 9529 - DNA, 20 bp, Artificial Sequence
  Description of Artificial Sequence: Synthetic oligonucleotide
gaagctgatcatgtctttgt

SEQ ID NO: 9530 - DNA, 20 bp, Artificial Sequence
  Description of Artificial Sequence: Synthetic oligonucleotide
aagctgatcatgtctttgtt

SEQ ID NO: 9531 - DNA, 20 bp, Artificial Sequence
  Description of Artificial Sequence: Synthetic oligonucleotide
agctgatcatgtctttgttc

SEQ ID NO: 9532 - DNA, 20 bp, Artificial Sequence
  Description of Artificial Sequence: Synthetic oligonucleotide
gctgatcatgtctttgttct

SEQ ID NO: 9533 - DNA, 20 bp, Artificial Sequence
  Description of Artificial Sequence: Synthetic oligonucleotide
ctgatcatgtctttgttctt

SEQ ID NO: 9534 - DNA, 20 bp, Artificial Sequence
  Description of Artificial Sequence: Synthetic oligonucleotide
tgatcatgtctttgttcttc

SEQ ID NO: 9535 - DNA, 20 bp, Artificial Sequence
  Description of Artificial Sequence: Synthetic oligonucleotide
gatcatgtctttgttcttca

SEQ ID NO: 9536 - DNA, 20 bp, Artificial Sequence
  Description of Artificial Sequence: Synthetic oligonucleotide
atcatgtctttgttcttcat

SEQ ID NO: 9537 - DNA, 20 bp, Artificial Sequence
  Description of Artificial Sequence: Synthetic oligonucleotide
tcatgtctttgttcttcatg

SEQ ID NO: 9538 - DNA, 20 bp, Artificial Sequence
  Description of Artificial Sequence: Synthetic oligonucleotide
catgtctttgttcttcatgt

SEQ ID NO: 9539 - DNA, 20 bp, Artificial Sequence
  Description of Artificial Sequence: Synthetic oligonucleotide
atgtctttgttcttcatgta

SEQ ID NO: 9540 - DNA, 20 bp, Artificial Sequence
  Description of Artificial Sequence: Synthetic oligonucleotide
tgtctttgttcttcatgtag

SEQ ID NO: 9541 - DNA, 20 bp, Artificial Sequence
  Description of Artificial Sequence: Synthetic oligonucleotide
gtctttgttcttcatgtagt

SEQ ID NO: 9542 - DNA, 20 bp, Artificial Sequence
  Description of Artificial Sequence: Synthetic oligonucleotide
tctttgttcttcatgtagtt

SEQ ID NO: 9543 - DNA, 20 bp, Artificial Sequence
  Description of Artificial Sequence: Synthetic oligonucleotide
ctttgttcttcatgtagttt

SEQ ID NO: 9544 - DNA, 20 bp, Artificial Sequence
  Description of Artificial Sequence: Synthetic oligonucleotide
tttgttcttcatgtagttta

SEQ ID NO: 9545 - DNA, 20 bp, Artificial Sequence
  Description of Artificial Sequence: Synthetic oligonucleotide
ttgttcttcatgtagtttat

SEQ ID NO: 9546 - DNA, 20 bp, Artificial Sequence
  Description of Artificial Sequence: Synthetic oligonucleotide
tgttcttcatgtagtttata

SEQ ID NO: 9547 - DNA, 20 bp, Artificial Sequence
  Description of Artificial Sequence: Synthetic oligonucleotide
gttcttcatgtagtttataa

SEQ ID NO: 9548 - DNA, 20 bp, Artificial Sequence
  Description of Artificial Sequence: Synthetic oligonucleotide
ttcttcatgtagtttataat

SEQ ID NO: 9549 - DNA, 20 bp, Artificial Sequence
  Description of Artificial Sequence: Synthetic oligonucleotide
tcttcatgtagtttataatg

SEQ ID NO: 9550 - DNA, 20 bp, Artificial Sequence
  Description of Artificial Sequence: Synthetic oligonucleotide
cttcatgtagtttataatgg

SEQ ID NO: 9551 - DNA, 20 bp, Artificial Sequence
  Description of Artificial Sequence: Synthetic oligonucleotide
ttcatgtagtttataatggg

SEQ ID NO: 9552 - DNA, 20 bp, Artificial Sequence
  Description of Artificial Sequence: Synthetic oligonucleotide
tcatgtagtttataatggga

SEQ ID NO: 9553 - DNA, 20 bp, Artificial Sequence
  Description of Artificial Sequence: Synthetic oligonucleotide
catgtagtttataatgggac

SEQ ID NO: 9554 - DNA, 20 bp, Artificial Sequence
  Description of Artificial Sequence: Synthetic oligonucleotide
atgtagtttataatgggacc

SEQ ID NO: 9555 - DNA, 20 bp, Artificial Sequence
  Description of Artificial Sequence: Synthetic oligonucleotide
tgtagtttataatgggacca

SEQ ID NO: 9556 - DNA, 20 bp, Artificial Sequence
  Description of Artificial Sequence: Synthetic oligonucleotide
gtagtttataatgggaccaa

SEQ ID NO: 9557 - DNA, 20 bp, Artificial Sequence
  Description of Artificial Sequence: Synthetic oligonucleotide
tagtttataatgggaccaat

SEQ ID NO: 9558 - DNA, 20 bp, Artificial Sequence
  Description of Artificial Sequence: Synthetic oligonucleotide
agtttataatgggaccaatg

SEQ ID NO: 9559 - DNA, 20 bp, Artificial Sequence
  Description of Artificial Sequence: Synthetic oligonucleotide
gtttataatgggaccaatgg

SEQ ID NO: 9560 - DNA, 20 bp, Artificial Sequence
  Description of Artificial Sequence: Synthetic oligonucleotide
tttataatgggaccaatggt

SEQ ID NO: 9561 - DNA, 20 bp, Artificial Sequence
  Description of Artificial Sequence: Synthetic oligonucleotide
ttataatgggaccaatggtt

SEQ ID NO: 9562 - DNA, 20 bp, Artificial Sequence
  Description of Artificial Sequence: Synthetic oligonucleotide
tataatgggaccaatggttt

SEQ ID NO: 9563 - DNA, 20 bp, Artificial Sequence
  Description of Artificial Sequence: Synthetic oligonucleotide
ataatgggaccaatggtttt

SEQ ID NO: 9564 - DNA, 20 bp, Artificial Sequence
  Description of Artificial Sequence: Synthetic oligonucleotide
taatgggaccaatggttttt

SEQ ID NO: 9565 - DNA, 20 bp, Artificial Sequence
  Description of Artificial Sequence: Synthetic oligonucleotide
aatgggaccaatggttttta

SEQ ID NO: 9566 - DNA, 20 bp, Artificial Sequence
  Description of Artificial Sequence: Synthetic oligonucleotide
atgggaccaatggtttttat

SEQ ID NO: 9567 - DNA, 20 bp, Artificial Sequence
  Description of Artificial Sequence: Synthetic oligonucleotide
tgggaccaatggtttttata

SEQ ID NO: 9568 - DNA, 20 bp, Artificial Sequence
  Description of Artificial Sequence: Synthetic oligonucleotide
gggaccaatggtttttatat

SEQ ID NO: 9569 - DNA, 20 bp, Artificial Sequence
  Description of Artificial Sequence: Synthetic oligonucleotide
ggaccaatggtttttatatc

SEQ ID NO: 9570 - DNA, 20 bp, Artificial Sequence
  Description of Artificial Sequence: Synthetic oligonucleotide
gaccaatggtttttatatca

SEQ ID NO: 9571 - DNA, 20 bp, Artificial Sequence
  Description of Artificial Sequence: Synthetic oligonucleotide
accaatggtttttatatcag

SEQ ID NO: 9572 - DNA, 20 bp, Artificial Sequence
  Description of Artificial Sequence: Synthetic oligonucleotide
ccaatggtttttatatcagc

SEQ ID NO: 9573 - DNA, 20 bp, Artificial Sequence
  Description of Artificial Sequence: Synthetic oligonucleotide
caatggtttttatatcagca

SEQ ID NO: 9574 - DNA, 20 bp, Artificial Sequence
  Description of Artificial Sequence: Synthetic oligonucleotide
aatggtttttatatcagcaa

SEQ ID NO: 9575 - DNA, 20 bp, Artificial Sequence
  Description of Artificial Sequence: Synthetic oligonucleotide
atggtttttatatcagcaag

SEQ ID NO: 9576 - DNA, 20 bp, Artificial Sequence
  Description of Artificial Sequence: Synthetic oligonucleotide
tggtttttatatcagcaaga

SEQ ID NO: 9577 - DNA, 20 bp, Artificial Sequence
  Description of Artificial Sequence: Synthetic oligonucleotide
ggtttttatatcagcaagaa

SEQ ID NO: 9578 - DNA, 20 bp, Artificial Sequence
  Description of Artificial Sequence: Synthetic oligonucleotide
gtttttatatcagcaagaaa

SEQ ID NO: 9579 - DNA, 20 bp, Artificial Sequence
  Description of Artificial Sequence: Synthetic oligonucleotide
tttttatatcagcaagaaat

SEQ ID NO: 9580 - DNA, 20 bp, Artificial Sequence
  Description of Artificial Sequence: Synthetic oligonucleotide
ttttatatcagcaagaaatg

SEQ ID NO: 9581 - DNA, 20 bp, Artificial Sequence
  Description of Artificial Sequence: Synthetic oligonucleotide
tttatatcagcaagaaatga

SEQ ID NO: 9582 - DNA, 20 bp, Artificial Sequence
  Description of Artificial Sequence: Synthetic oligonucleotide
ttatatcagcaagaaatgac

SEQ ID NO: 9583 - DNA, 20 bp, Artificial Sequence
  Description of Artificial Sequence: Synthetic oligonucleotide
tatatcagcaagaaatgaca

SEQ ID NO: 9584 - DNA, 20 bp, Artificial Sequence
  Description of Artificial Sequence: Synthetic oligonucleotide
atatcagcaagaaatgacat

SEQ ID NO: 9585 - DNA, 20 bp, Artificial Sequence
  Description of Artificial Sequence: Synthetic oligonucleotide
tatcagcaagaaatgacatg

SEQ ID NO: 9586 - DNA, 20 bp, Artificial Sequence
  Description of Artificial Sequence: Synthetic oligonucleotide
atcagcaagaaatgacatgt

SEQ ID NO: 9587 - DNA, 20 bp, Artificial Sequence
  Description of Artificial Sequence: Synthetic oligonucleotide
tcagcaagaaatgacatgtc

SEQ ID NO: 9588 - DNA, 20 bp, Artificial Sequence
  Description of Artificial Sequence: Synthetic oligonucleotide
cagcaagaaatgacatgtct

SEQ ID NO: 9589 - DNA, 20 bp, Artificial Sequence
  Description of Artificial Sequence: Synthetic oligonucleotide
agcaagaaatgacatgtcta

SEQ ID NO: 9590 - DNA, 20 bp, Artificial Sequence
  Description of Artificial Sequence: Synthetic oligonucleotide
gcaagaaatgacatgtctat

SEQ ID NO: 9591 - DNA, 20 bp, Artificial Sequence
  Description of Artificial Sequence: Synthetic oligonucleotide
caagaaatgacatgtctata

SEQ ID NO: 9592 - DNA, 20 bp, Artificial Sequence
  Description of Artificial Sequence: Synthetic oligonucleotide
aagaaatgacatgtctatag

SEQ ID NO: 9593 - DNA, 20 bp, Artificial Sequence
  Description of Artificial Sequence: Synthetic oligonucleotide
agaaatgacatgtctatagg

SEQ ID NO: 9594 - DNA, 20 bp, Artificial Sequence
  Description of Artificial Sequence: Synthetic oligonucleotide
gaaatgacatgtctatagga

SEQ ID NO: 9595 - DNA, 20 bp, Artificial Sequence
  Description of Artificial Sequence: Synthetic oligonucleotide
aaatgacatgtctataggat

SEQ ID NO: 9596 - DNA, 20 bp, Artificial Sequence
  Description of Artificial Sequence: Synthetic oligonucleotide
aatgacatgtctataggata

SEQ ID NO: 9597 - DNA, 20 bp, Artificial Sequence
  Description of Artificial Sequence: Synthetic oligonucleotide
atgacatgtctataggatat

SEQ ID NO: 9598 - DNA, 20 bp, Artificial Sequence
  Description of Artificial Sequence: Synthetic oligonucleotide
tgacatgtctataggatatg

SEQ ID NO: 9599 - DNA, 20 bp, Artificial Sequence
  Description of Artificial Sequence: Synthetic oligonucleotide
gacatgtctataggatatgc

SEQ ID NO: 9600 - DNA, 20 bp, Artificial Sequence
  Description of Artificial Sequence: Synthetic oligonucleotide
acatgtctataggatatgct

SEQ ID NO: 9601 - DNA, 20 bp, Artificial Sequence
  Description of Artificial Sequence: Synthetic oligonucleotide
catgtctataggatatgctc

SEQ ID NO: 9602 - DNA, 20 bp, Artificial Sequence
  Description of Artificial Sequence: Synthetic oligonucleotide
atgtctataggatatgctcc

SEQ ID NO: 9603 - DNA, 20 bp, Artificial Sequence
  Description of Artificial Sequence: Synthetic oligonucleotide
tgtctataggatatgctcct

SEQ ID NO: 9604 - DNA, 20 bp, Artificial Sequence
  Description of Artificial Sequence: Synthetic oligonucleotide
gtctataggatatgctcctt

SEQ ID NO: 9605 - DNA, 20 bp, Artificial Sequence
  Description of Artificial Sequence: Synthetic oligonucleotide
tctataggatatgctcctta

SEQ ID NO: 9606 - DNA, 20 bp, Artificial Sequence
  Description of Artificial Sequence: Synthetic oligonucleotide
ctataggatatgctccttac

SEQ ID NO: 9607 - DNA, 20 bp, Artificial Sequence
  Description of Artificial Sequence: Synthetic oligonucleotide
tataggatatgctccttaca

SEQ ID NO: 9608 - DNA, 20 bp, Artificial Sequence
  Description of Artificial Sequence: Synthetic oligonucleotide
ataggatatgctccttacaa

SEQ ID NO: 9609 - DNA, 20 bp, Artificial Sequence
  Description of Artificial Sequence: Synthetic oligonucleotide
taggatatgctccttacaac

SEQ ID NO: 9610 - DNA, 20 bp, Artificial Sequence
  Description of Artificial Sequence: Synthetic oligonucleotide
aggatatgctccttacaact

SEQ ID NO: 9611 - DNA, 20 bp, Artificial Sequence
  Description of Artificial Sequence: Synthetic oligonucleotide
ggatatgctccttacaacta

SEQ ID NO: 9612 - DNA, 20 bp, Artificial Sequence
  Description of Artificial Sequence: Synthetic oligonucleotide
gatatgctccttacaactaa

SEQ ID NO: 9613 - DNA, 20 bp, Artificial Sequence
  Description of Artificial Sequence: Synthetic oligonucleotide
atatgctccttacaactaat

SEQ ID NO: 9614 - DNA, 20 bp, Artificial Sequence
  Description of Artificial Sequence: Synthetic oligonucleotide
tatgctccttacaactaata

SEQ ID NO: 9615 - DNA, 20 bp, Artificial Sequence
  Description of Artificial Sequence: Synthetic oligonucleotide
atgctccttacaactaatat

SEQ ID NO: 9616 - DNA, 20 bp, Artificial Sequence
  Description of Artificial Sequence: Synthetic oligonucleotide
tgctccttacaactaatatt

SEQ ID NO: 9617 - DNA, 20 bp, Artificial Sequence
  Description of Artificial Sequence: Synthetic oligonucleotide
gctccttacaactaatattt

SEQ ID NO: 9618 - DNA, 20 bp, Artificial Sequence
  Description of Artificial Sequence: Synthetic oligonucleotide
ctccttacaactaatatttt

SEQ ID NO: 9619 - DNA, 20 bp, Artificial Sequence
  Description of Artificial Sequence: Synthetic oligonucleotide
tccttacaactaatattttc

SEQ ID NO: 9620 - DNA, 20 bp, Artificial Sequence
  Description of Artificial Sequence: Synthetic oligonucleotide
ccttacaactaatattttcc

SEQ ID NO: 9621 - DNA, 20 bp, Artificial Sequence
  Description of Artificial Sequence: Synthetic oligonucleotide
cttacaactaatattttcct

SEQ ID NO: 9622 - DNA, 20 bp, Artificial Sequence
  Description of Artificial Sequence: Synthetic oligonucleotide
ttacaactaatattttcctg

SEQ ID NO: 9623 - DNA, 20 bp, Artificial Sequence
  Description of Artificial Sequence: Synthetic oligonucleotide
tacaactaatattttcctga

SEQ ID NO: 9624 - DNA, 20 bp, Artificial Sequence
  Description of Artificial Sequence: Synthetic oligonucleotide
acaactaatattttcctgat

SEQ ID NO: 9625 - DNA, 20 bp, Artificial Sequence
  Description of Artificial Sequence: Synthetic oligonucleotide
caactaatattttcctgata

SEQ ID NO: 9626 - DNA, 20 bp, Artificial Sequence
  Description of Artificial Sequence: Synthetic oligonucleotide
aactaatattttcctgataa

SEQ ID NO: 9627 - DNA, 20 bp, Artificial Sequence
  Description of Artificial Sequence: Synthetic oligonucleotide
actaatattttcctgataat

SEQ ID NO: 9628 - DNA, 20 bp, Artificial Sequence
  Description of Artificial Sequence: Synthetic oligonucleotide
ctaatattttcctgataatt

SEQ ID NO: 9629 - DNA, 20 bp, Artificial Sequence
  Description of Artificial Sequence: Synthetic oligonucleotide
taatattttcctgataattt

SEQ ID NO: 9630 - DNA, 20 bp, Artificial Sequence
  Description of Artificial Sequence: Synthetic oligonucleotide
aatattttcctgataatttc

SEQ ID NO: 9631 - DNA, 20 bp, Artificial Sequence
  Description of Artificial Sequence: Synthetic oligonucleotide
atattttcctgataatttca

SEQ ID NO: 9632 - DNA, 20 bp, Artificial Sequence
  Description of Artificial Sequence: Synthetic oligonucleotide
tattttcctgataatttcag

SEQ ID NO: 9633 - DNA, 20 bp, Artificial Sequence
  Description of Artificial Sequence: Synthetic oligonucleotide
attttcctgataatttcaga

SEQ ID NO: 9634 - DNA, 20 bp, Artificial Sequence
  Description of Artificial Sequence: Synthetic oligonucleotide
ttttcctgataatttcagaa

SEQ ID NO: 9635 - DNA, 20 bp, Artificial Sequence
  Description of Artificial Sequence: Synthetic oligonucleotide
tttcctgataatttcagaaa

SEQ ID NO: 9636 - DNA, 20 bp, Artificial Sequence
  Description of Artificial Sequence: Synthetic oligonucleotide
ttcctgataatttcagaaaa

SEQ ID NO: 9637 - DNA, 20 bp, Artificial Sequence
  Description of Artificial Sequence: Synthetic oligonucleotide
tcctgataatttcagaaaac

SEQ ID NO: 9638 - DNA, 20 bp, Artificial Sequence
  Description of Artificial Sequence: Synthetic oligonucleotide
cctgataatttcagaaaacc

SEQ ID NO: 9639 - DNA, 20 bp, Artificial Sequence
  Description of Artificial Sequence: Synthetic oligonucleotide
ctgataatttcagaaaacca

SEQ ID NO: 9640 - DNA, 20 bp, Artificial Sequence
  Description of Artificial Sequence: Synthetic oligonucleotide
tgataatttcagaaaaccaa

SEQ ID NO: 9641 - DNA, 20 bp, Artificial Sequence
  Description of Artificial Sequence: Synthetic oligonucleotide
gataatttcagaaaaccaaa

SEQ ID NO: 9642 - DNA, 20 bp, Artificial Sequence
  Description of Artificial Sequence: Synthetic oligonucleotide
ataatttcagaaaaccaaat

SEQ ID NO: 9643 - DNA, 20 bp, Artificial Sequence
  Description of Artificial Sequence: Synthetic oligonucleotide
taatttcagaaaaccaaatt

SEQ ID NO: 9644 - DNA, 20 bp, Artificial Sequence
  Description of Artificial Sequence: Synthetic oligonucleotide
aatttcagaaaaccaaattt

SEQ ID NO: 9645 - DNA, 20 bp, Artificial Sequence
  Description of Artificial Sequence: Synthetic oligonucleotide
atttcagaaaaccaaatttt

SEQ ID NO: 9646 - DNA, 20 bp, Artificial Sequence
  Description of Artificial Sequence: Synthetic oligonucleotide
tttcagaaaaccaaattttt

SEQ ID NO: 9647 - DNA, 20 bp, Artificial Sequence
  Description of Artificial Sequence: Synthetic oligonucleotide
ttcagaaaaccaaattttta

SEQ ID NO: 9648 - DNA, 20 bp, Artificial Sequence
  Description of Artificial Sequence: Synthetic oligonucleotide
tcagaaaaccaaatttttat

SEQ ID NO: 9649 - DNA, 20 bp, Artificial Sequence
  Description of Artificial Sequence: Synthetic oligonucleotide
cagaaaaccaaatttttatc

SEQ ID NO: 9650 - DNA, 20 bp, Artificial Sequence
  Description of Artificial Sequence: Synthetic oligonucleotide
agaaaaccaaatttttatct

SEQ ID NO: 9651 - DNA, 20 bp, Artificial Sequence
  Description of Artificial Sequence: Synthetic oligonucleotide
gaaaaccaaatttttatctc

SEQ ID NO: 9652 - DNA, 20 bp, Artificial Sequence
  Description of Artificial Sequence: Synthetic oligonucleotide
aaaaccaaatttttatctct

SEQ ID NO: 9653 - DNA, 20 bp, Artificial Sequence
  Description of Artificial Sequence: Synthetic oligonucleotide
aaaccaaatttttatctcta

SEQ ID NO: 9654 - DNA, 20 bp, Artificial Sequence
  Description of Artificial Sequence: Synthetic oligonucleotide
aaccaaatttttatctctaa

SEQ ID NO: 9655 - DNA, 20 bp, Artificial Sequence
  Description of Artificial Sequence: Synthetic oligonucleotide
accaaatttttatctctaaa

SEQ ID NO: 9656 - DNA, 20 bp, Artificial Sequence
  Description of Artificial Sequence: Synthetic oligonucleotide
ccaaatttttatctctaaac

SEQ ID NO: 9657 - DNA, 20 bp, Artificial Sequence
  Description of Artificial Sequence: Synthetic oligonucleotide
caaatttttatctctaaacc

SEQ ID NO: 9658 - DNA, 20 bp, Artificial Sequence
  Description of Artificial Sequence: Synthetic oligonucleotide
aaatttttatctctaaaccg

SEQ ID NO: 9659 - DNA, 20 bp, Artificial Sequence
  Description of Artificial Sequence: Synthetic oligonucleotide
aatttttatctctaaaccgt

SEQ ID NO: 9660 - DNA, 20 bp, Artificial Sequence
  Description of Artificial Sequence: Synthetic oligonucleotide
atttttatctctaaaccgta

SEQ ID NO: 9661 - DNA, 20 bp, Artificial Sequence
  Description of Artificial Sequence: Synthetic oligonucleotide
tttttatctctaaaccgtaa

SEQ ID NO: 9662 - DNA, 20 bp, Artificial Sequence
  Description of Artificial Sequence: Synthetic oligonucleotide
ttttatctctaaaccgtaaa

SEQ ID NO: 9663 - DNA, 20 bp, Artificial Sequence
  Description of Artificial Sequence: Synthetic oligonucleotide
tttatctctaaaccgtaaat

SEQ ID NO: 9664 - DNA, 20 bp, Artificial Sequence
  Description of Artificial Sequence: Synthetic oligonucleotide
ttatctctaaaccgtaaatt

SEQ ID NO: 9665 - DNA, 20 bp, Artificial Sequence
  Description of Artificial Sequence: Synthetic oligonucleotide
tatctctaaaccgtaaattc

SEQ ID NO: 9666 - DNA, 20 bp, Artificial Sequence
  Description of Artificial Sequence: Synthetic oligonucleotide
atctctaaaccgtaaattca

SEQ ID NO: 9667 - DNA, 20 bp, Artificial Sequence
  Description of Artificial Sequence: Synthetic oligonucleotide
tctctaaaccgtaaattcat

SEQ ID NO: 9668 - DNA, 20 bp, Artificial Sequence
  Description of Artificial Sequence: Synthetic oligonucleotide
ctctaaaccgtaaattcatg

SEQ ID NO: 9669 - DNA, 20 bp, Artificial Sequence
  Description of Artificial Sequence: Synthetic oligonucleotide
tctaaaccgtaaattcatgt

SEQ ID NO: 9670 - DNA, 20 bp, Artificial Sequence
  Description of Artificial Sequence: Synthetic oligonucleotide
ctaaaccgtaaattcatgtt

SEQ ID NO: 9671 - DNA, 20 bp, Artificial Sequence
  Description of Artificial Sequence: Synthetic oligonucleotide
taaaccgtaaattcatgttg

SEQ ID NO: 9672 - DNA, 20 bp, Artificial Sequence
  Description of Artificial Sequence: Synthetic oligonucleotide
aaaccgtaaattcatgttgg

SEQ ID NO: 9673 - DNA, 20 bp, Artificial Sequence
  Description of Artificial Sequence: Synthetic oligonucleotide
aaccgtaaattcatgttggc

SEQ ID NO: 9674 - DNA, 20 bp, Artificial Sequence
  Description of Artificial Sequence: Synthetic oligonucleotide
accgtaaattcatgttggcc

SEQ ID NO: 9675 - DNA, 20 bp, Artificial Sequence
  Description of Artificial Sequence: Synthetic oligonucleotide
ccgtaaattcatgttggccc

SEQ ID NO: 9676 - DNA, 20 bp, Artificial Sequence
  Description of Artificial Sequence: Synthetic oligonucleotide
cgtaaattcatgttggccca

SEQ ID NO: 9677 - DNA, 20 bp, Artificial Sequence
  Description of Artificial Sequence: Synthetic oligonucleotide
gtaaattcatgttggcccac

SEQ ID NO: 9678 - DNA, 20 bp, Artificial Sequence
  Description of Artificial Sequence: Synthetic oligonucleotide
taaattcatgttggcccacc

SEQ ID NO: 9679 - DNA, 20 bp, Artificial Sequence
  Description of Artificial Sequence: Synthetic oligonucleotide
aaattcatgttggcccacct

SEQ ID NO: 9680 - DNA, 20 bp, Artificial Sequence
  Description of Artificial Sequence: Synthetic oligonucleotide
aattcatgttggcccacctg

SEQ ID NO: 9681 - DNA, 20 bp, Artificial Sequence
  Description of Artificial Sequence: Synthetic oligonucleotide
attcatgttggcccacctga

SEQ ID NO: 9682 - DNA, 20 bp, Artificial Sequence
  Description of Artificial Sequence: Synthetic oligonucleotide
ttcatgttggcccacctgag

SEQ ID NO: 9683 - DNA, 20 bp, Artificial Sequence
  Description of Artificial Sequence: Synthetic oligonucleotide
tcatgttggcccacctgagc

SEQ ID NO: 9684 - DNA, 20 bp, Artificial Sequence
  Description of Artificial Sequence: Synthetic oligonucleotide
catgttggcccacctgagct

SEQ ID NO: 9685 - DNA, 20 bp, Artificial Sequence
  Description of Artificial Sequence: Synthetic oligonucleotide
atgttggcccacctgagctg

SEQ ID NO: 9686 - DNA, 20 bp, Artificial Sequence
  Description of Artificial Sequence: Synthetic oligonucleotide
tgttggcccacctgagctga

SEQ ID NO: 9687 - DNA, 20 bp, Artificial Sequence
  Description of Artificial Sequence: Synthetic oligonucleotide
gttggcccacctgagctgag

SEQ ID NO: 9688 - DNA, 20 bp, Artificial Sequence
  Description of Artificial Sequence: Synthetic oligonucleotide
ttggcccacctgagctgagc

SEQ ID NO: 9689 - DNA, 20 bp, Artificial Sequence
  Description of Artificial Sequence: Synthetic oligonucleotide
tggcccacctgagctgagct

SEQ ID NO: 9690 - DNA, 20 bp, Artificial Sequence
  Description of Artificial Sequence: Synthetic oligonucleotide
ggcccacctgagctgagcta

SEQ ID NO: 9691 - DNA, 20 bp, Artificial Sequence
  Description of Artificial Sequence: Synthetic oligonucleotide
gcccacctgagctgagctaa

SEQ ID NO: 9692 - DNA, 20 bp, Artificial Sequence
  Description of Artificial Sequence: Synthetic oligonucleotide
cccacctgagctgagctaac

SEQ ID NO: 9693 - DNA, 20 bp, Artificial Sequence
  Description of Artificial Sequence: Synthetic oligonucleotide
ccacctgagctgagctaacc

SEQ ID NO: 9694 - DNA, 20 bp, Artificial Sequence
  Description of Artificial Sequence: Synthetic oligonucleotide
cacctgagctgagctaacca

SEQ ID NO: 9695 - DNA, 20 bp, Artificial Sequence
  Description of Artificial Sequence: Synthetic oligonucleotide
acctgagctgagctaaccag

SEQ ID NO: 9696 - DNA, 20 bp, Artificial Sequence
  Description of Artificial Sequence: Synthetic oligonucleotide
cctgagctgagctaaccaga

SEQ ID NO: 9697 - DNA, 20 bp, Artificial Sequence
  Description of Artificial Sequence: Synthetic oligonucleotide
ctgagctgagctaaccagaa

SEQ ID NO: 9698 - DNA, 20 bp, Artificial Sequence
  Description of Artificial Sequence: Synthetic oligonucleotide
tgagctgagctaaccagaaa

SEQ ID NO: 9699 - DNA, 20 bp, Artificial Sequence
  Description of Artificial Sequence: Synthetic oligonucleotide
gagctgagctaaccagaaat

SEQ ID NO: 9700 - DNA, 20 bp, Artificial Sequence
  Description of Artificial Sequence: Synthetic oligonucleotide
agctgagctaaccagaaata

SEQ ID NO: 9701 - DNA, 20 bp, Artificial Sequence
  Description of Artificial Sequence: Synthetic oligonucleotide
gctgagctaaccagaaataa

SEQ ID NO: 9702 - DNA, 20 bp, Artificial Sequence
  Description of Artificial Sequence: Synthetic oligonucleotide
ctgagctaaccagaaataaa

SEQ ID NO: 9703 - DNA, 20 bp, Artificial Sequence
  Description of Artificial Sequence: Synthetic oligonucleotide
tgagctaaccagaaataaaa

SEQ ID NO: 9704 - DNA, 20 bp, Artificial Sequence
  Description of Artificial Sequence: Synthetic oligonucleotide
gagctaaccagaaataaaag

SEQ ID NO: 9705 - DNA, 20 bp, Artificial Sequence
  Description of Artificial Sequence: Synthetic oligonucleotide
agctaaccagaaataaaagt

SEQ ID NO: 9706 - DNA, 20 bp, Artificial Sequence
  Description of Artificial Sequence: Synthetic oligonucleotide
gctaaccagaaataaaagtt

SEQ ID NO: 9707 - DNA, 20 bp, Artificial Sequence
  Description of Artificial Sequence: Synthetic oligonucleotide
ctaaccagaaataaaagtta

SEQ ID NO: 9708 - DNA, 20 bp, Artificial Sequence
  Description of Artificial Sequence: Synthetic oligonucleotide
taaccagaaataaaagttat

SEQ ID NO: 9709 - DNA, 20 bp, Artificial Sequence
  Description of Artificial Sequence: Synthetic oligonucleotide
aaccagaaataaaagttatt

SEQ ID NO: 9710 - DNA, 20 bp, Artificial Sequence
  Description of Artificial Sequence: Synthetic oligonucleotide
accagaaataaaagttattt

SEQ ID NO: 9711 - DNA, 20 bp, Artificial Sequence
  Description of Artificial Sequence: Synthetic oligonucleotide
ccagaaataaaagttatttt

SEQ ID NO: 9712 - DNA, 20 bp, Artificial Sequence
  Description of Artificial Sequence: Synthetic oligonucleotide
cagaaataaaagttattttg

SEQ ID NO: 9713 - DNA, 20 bp, Artificial Sequence
  Description of Artificial Sequence: Synthetic oligonucleotide
agaaataaaagttattttgc

SEQ ID NO: 9714 - DNA, 20 bp, Artificial Sequence
  Description of Artificial Sequence: Synthetic oligonucleotide
gaaataaaagttattttgca

SEQ ID NO: 9715 - DNA, 20 bp, Artificial Sequence
  Description of Artificial Sequence: Synthetic oligonucleotide
aaataaaagttattttgcaa

SEQ ID NO: 9716 - DNA, 20 bp, Artificial Sequence
  Description of Artificial Sequence: Synthetic oligonucleotide
aataaaagttattttgcaaa

SEQ ID NO: 9717 - DNA, 20 bp, Artificial Sequence
  Description of Artificial Sequence: Synthetic oligonucleotide
ataaaagttattttgcaaaa

SEQ ID NO: 9718 - DNA, 20 bp, Artificial Sequence
  Description of Artificial Sequence: Synthetic oligonucleotide
taaaagttattttgcaaaag

SEQ ID NO: 9719 - DNA, 20 bp, Artificial Sequence
  Description of Artificial Sequence: Synthetic oligonucleotide
aaaagttattttgcaaaaga

SEQ ID NO: 9720 - DNA, 20 bp, Artificial Sequence
  Description of Artificial Sequence: Synthetic oligonucleotide
aaagttattttgcaaaagaa

SEQ ID NO: 9721 - DNA, 20 bp, Artificial Sequence
  Description of Artificial Sequence: Synthetic oligonucleotide
aagttattttgcaaaagaaa

SEQ ID NO: 9722 - DNA, 20 bp, Artificial Sequence
  Description of Artificial Sequence: Synthetic oligonucleotide
agttattttgcaaaagaaag

SEQ ID NO: 9723 - DNA, 20 bp, Artificial Sequence
  Description of Artificial Sequence: Synthetic oligonucleotide
gttattttgcaaaagaaaga

SEQ ID NO: 9724 - DNA, 20 bp, Artificial Sequence
  Description of Artificial Sequence: Synthetic oligonucleotide
ttattttgcaaaagaaagat

SEQ ID NO: 9725 - DNA, 20 bp, Artificial Sequence
  Description of Artificial Sequence: Synthetic oligonucleotide
tattttgcaaaagaaagatt

SEQ ID NO: 9726 - DNA, 20 bp, Artificial Sequence
  Description of Artificial Sequence: Synthetic oligonucleotide
attttgcaaaagaaagatta

SEQ ID NO: 9727 - DNA, 20 bp, Artificial Sequence
  Description of Artificial Sequence: Synthetic oligonucleotide
ttttgcaaaagaaagattaa

SEQ ID NO: 9728 - DNA, 20 bp, Artificial Sequence
  Description of Artificial Sequence: Synthetic oligonucleotide
tttgcaaaagaaagattaaa

SEQ ID NO: 9729 - DNA, 20 bp, Artificial Sequence
  Description of Artificial Sequence: Synthetic oligonucleotide
ttgcaaaagaaagattaaat

SEQ ID NO: 9730 - DNA, 20 bp, Artificial Sequence
  Description of Artificial Sequence: Synthetic oligonucleotide
tgcaaaagaaagattaaatt

SEQ ID NO: 9731 - DNA, 20 bp, Artificial Sequence
  Description of Artificial Sequence: Synthetic oligonucleotide
gcaaaagaaagattaaattt

SEQ ID NO: 9732 - DNA, 20 bp, Artificial Sequence
  Description of Artificial Sequence: Synthetic oligonucleotide
caaaagaaagattaaattta

SEQ ID NO: 9733 - DNA, 20 bp, Artificial Sequence
  Description of Artificial Sequence: Synthetic oligonucleotide
aaaagaaagattaaatttat

SEQ ID NO: 9734 - DNA, 20 bp, Artificial Sequence
  Description of Artificial Sequence: Synthetic oligonucleotide
aaagaaagattaaatttatc

SEQ ID NO: 9735 - DNA, 20 bp, Artificial Sequence
  Description of Artificial Sequence: Synthetic oligonucleotide
aagaaagattaaatttatct

SEQ ID NO: 9736 - DNA, 20 bp, Artificial Sequence
  Description of Artificial Sequence: Synthetic oligonucleotide
agaaagattaaatttatctt

SEQ ID NO: 9737 - DNA, 20 bp, Artificial Sequence
  Description of Artificial Sequence: Synthetic oligonucleotide
gaaagattaaatttatctta

SEQ ID NO: 9738 - DNA, 20 bp, Artificial Sequence
  Description of Artificial Sequence: Synthetic oligonucleotide
aaagattaaatttatcttat

SEQ ID NO: 9739 - DNA, 20 bp, Artificial Sequence
  Description of Artificial Sequence: Synthetic oligonucleotide
aagattaaatttatcttatt

SEQ ID NO: 9740 - DNA, 20 bp, Artificial Sequence
  Description of Artificial Sequence: Synthetic oligonucleotide
agattaaatttatcttattt

SEQ ID NO: 9741 - DNA, 20 bp, Artificial Sequence
  Description of Artificial Sequence: Synthetic oligonucleotide
gattaaatttatcttatttt

SEQ ID NO: 9742 - DNA, 20 bp, Artificial Sequence
  Description of Artificial Sequence: Synthetic oligonucleotide
attaaatttatcttattttt

SEQ ID NO: 9743 - DNA, 20 bp, Artificial Sequence
  Description of Artificial Sequence: Synthetic oligonucleotide
ttaaatttatcttatttttg

SEQ ID NO: 9744 - DNA, 20 bp, Artificial Sequence
  Description of Artificial Sequence: Synthetic oligonucleotide
taaatttatcttatttttgg

SEQ ID NO: 9745 - DNA, 20 bp, Artificial Sequence
  Description of Artificial Sequence: Synthetic oligonucleotide
aaatttatcttatttttggc

SEQ ID NO: 9746 - DNA, 20 bp, Artificial Sequence
  Description of Artificial Sequence: Synthetic oligonucleotide
aatttatcttatttttggcc

SEQ ID NO: 9747 - DNA, 20 bp, Artificial Sequence
  Description of Artificial Sequence: Synthetic oligonucleotide
atttatcttatttttggcct

SEQ ID NO: 9748 - DNA, 20 bp, Artificial Sequence
  Description of Artificial Sequence: Synthetic oligonucleotide
tttatcttatttttggccta

SEQ ID NO: 9749 - DNA, 20 bp, Artificial Sequence
  Description of Artificial Sequence: Synthetic oligonucleotide
ttatcttatttttggcctat

SEQ ID NO: 9750 - DNA, 20 bp, Artificial Sequence
  Description of Artificial Sequence: Synthetic oligonucleotide
tatcttatttttggcctatt

SEQ ID NO: 9751 - DNA, 20 bp, Artificial Sequence
  Description of Artificial Sequence: Synthetic oligonucleotide
atcttatttttggcctatta

SEQ ID NO: 9752 - DNA, 20 bp, Artificial Sequence
  Description of Artificial Sequence: Synthetic oligonucleotide
tcttatttttggcctattaa

SEQ ID NO: 9753 - DNA, 20 bp, Artificial Sequence
  Description of Artificial Sequence: Synthetic oligonucleotide
cttatttttggcctattaag

SEQ ID NO: 9754 - DNA, 20 bp, Artificial Sequence
  Description of Artificial Sequence: Synthetic oligonucleotide
ttatttttggcctattaagt

SEQ ID NO: 9755 - DNA, 20 bp, Artificial Sequence
  Description of Artificial Sequence: Synthetic oligonucleotide
tatttttggcctattaagtc

SEQ ID NO: 9756 - DNA, 20 bp, Artificial Sequence
  Description of Artificial Sequence: Synthetic oligonucleotide
atttttggcctattaagtct

SEQ ID NO: 9757 - DNA, 20 bp, Artificial Sequence
  Description of Artificial Sequence: Synthetic oligonucleotide
tttttggcctattaagtcta

SEQ ID NO: 9758 - DNA, 20 bp, Artificial Sequence
  Description of Artificial Sequence: Synthetic oligonucleotide
ttttggcctattaagtctat

SEQ ID NO: 9759 - DNA, 20 bp, Artificial Sequence
  Description of Artificial Sequence: Synthetic oligonucleotide
tttggcctattaagtctata

SEQ ID NO: 9760 - DNA, 20 bp, Artificial Sequence
  Description of Artificial Sequence: Synthetic oligonucleotide
ttggcctattaagtctatat

SEQ ID NO: 9761 - DNA, 20 bp, Artificial Sequence
  Description of Artificial Sequence: Synthetic oligonucleotide
tggcctattaagtctatatt

SEQ ID NO: 9762 - DNA, 20 bp, Artificial Sequence
  Description of Artificial Sequence: Synthetic oligonucleotide
ggcctattaagtctatattt

SEQ ID NO: 9763 - DNA, 20 bp, Artificial Sequence
  Description of Artificial Sequence: Synthetic oligonucleotide
gcctattaagtctatatttc

SEQ ID NO: 9764 - DNA, 20 bp, Artificial Sequence
  Description of Artificial Sequence: Synthetic oligonucleotide
cctattaagtctatatttca

SEQ ID NO: 9765 - DNA, 20 bp, Artificial Sequence
  Description of Artificial Sequence: Synthetic oligonucleotide
ctattaagtctatatttcag

SEQ ID NO: 9766 - DNA, 20 bp, Artificial Sequence
  Description of Artificial Sequence: Synthetic oligonucleotide
tattaagtctatatttcagc

SEQ ID NO: 9767 - DNA, 20 bp, Artificial Sequence
  Description of Artificial Sequence: Synthetic oligonucleotide
attaagtctatatttcagca

SEQ ID NO: 9768 - DNA, 20 bp, Artificial Sequence
  Description of Artificial Sequence: Synthetic oligonucleotide
ttaagtctatatttcagcat

SEQ ID NO: 9769 - DNA, 20 bp, Artificial Sequence
  Description of Artificial Sequence: Synthetic oligonucleotide
taagtctatatttcagcatt

SEQ ID NO: 9770 - DNA, 20 bp, Artificial Sequence
  Description of Artificial Sequence: Synthetic oligonucleotide
aagtctatatttcagcattg

SEQ ID NO: 9771 - DNA, 20 bp, Artificial Sequence
  Description of Artificial Sequence: Synthetic oligonucleotide
agtctatatttcagcattgc

SEQ ID NO: 9772 - DNA, 20 bp, Artificial Sequence
  Description of Artificial Sequence: Synthetic oligonucleotide
gtctatatttcagcattgca

SEQ ID NO: 9773 - DNA, 20 bp, Artificial Sequence
  Description of Artificial Sequence: Synthetic oligonucleotide
tctatatttcagcattgcat

SEQ ID NO: 9774 - DNA, 20 bp, Artificial Sequence
  Description of Artificial Sequence: Synthetic oligonucleotide
ctatatttcagcattgcatt

SEQ ID NO: 9775 - DNA, 20 bp, Artificial Sequence
  Description of Artificial Sequence: Synthetic oligonucleotide
tatatttcagcattgcattt

SEQ ID NO: 9776 - DNA, 20 bp, Artificial Sequence
  Description of Artificial Sequence: Synthetic oligonucleotide
atatttcagcattgcattta

SEQ ID NO: 9777 - DNA, 20 bp, Artificial Sequence
  Description of Artificial Sequence: Synthetic oligonucleotide
tatttcagcattgcatttaa

SEQ ID NO: 9778 - DNA, 20 bp, Artificial Sequence
  Description of Artificial Sequence: Synthetic oligonucleotide
atttcagcattgcatttaaa

SEQ ID NO: 9779 - DNA, 20 bp, Artificial Sequence
  Description of Artificial Sequence: Synthetic oligonucleotide
tttcagcattgcatttaaaa

SEQ ID NO: 9780 - DNA, 20 bp, Artificial Sequence
  Description of Artificial Sequence: Synthetic oligonucleotide
ttcagcattgcatttaaaaa

SEQ ID NO: 9781 - DNA, 20 bp, Artificial Sequence
  Description of Artificial Sequence: Synthetic oligonucleotide
tcagcattgcatttaaaaaa

SEQ ID NO: 9782 - DNA, 20 bp, Artificial Sequence
  Description of Artificial Sequence: Synthetic oligonucleotide
cagcattgcatttaaaaaat

SEQ ID NO: 9783 - DNA, 20 bp, Artificial Sequence
  Description of Artificial Sequence: Synthetic oligonucleotide
agcattgcatttaaaaaatc

SEQ ID NO: 9784 - DNA, 20 bp, Artificial Sequence
  Description of Artificial Sequence: Synthetic oligonucleotide
gcattgcatttaaaaaatcc

SEQ ID NO: 9785 - DNA, 20 bp, Artificial Sequence
  Description of Artificial Sequence: Synthetic oligonucleotide
cattgcatttaaaaaatcct

SEQ ID NO: 9786 - DNA, 20 bp, Artificial Sequence
  Description of Artificial Sequence: Synthetic oligonucleotide
attgcatttaaaaaatcctg

SEQ ID NO: 9787 - DNA, 20 bp, Artificial Sequence
  Description of Artificial Sequence: Synthetic oligonucleotide
ttgcatttaaaaaatcctgt

SEQ ID NO: 9788 - DNA, 20 bp, Artificial Sequence
  Description of Artificial Sequence: Synthetic oligonucleotide
tgcatttaaaaaatcctgta

SEQ ID NO: 9789 - DNA, 20 bp, Artificial Sequence
  Description of Artificial Sequence: Synthetic oligonucleotide
gcatttaaaaaatcctgtat

SEQ ID NO: 9790 - DNA, 20 bp, Artificial Sequence
  Description of Artificial Sequence: Synthetic oligonucleotide
catttaaaaaatcctgtatt

SEQ ID NO: 9791 - DNA, 20 bp, Artificial Sequence
  Description of Artificial Sequence: Synthetic oligonucleotide
atttaaaaaatcctgtattc

SEQ ID NO: 9792 - DNA, 20 bp, Artificial Sequence
  Description of Artificial Sequence: Synthetic oligonucleotide
tttaaaaaatcctgtattcg

SEQ ID NO: 9793 - DNA, 20 bp, Artificial Sequence
  Description of Artificial Sequence: Synthetic oligonucleotide
ttaaaaaatcctgtattcgg

SEQ ID NO: 9794 - DNA, 20 bp, Artificial Sequence
  Description of Artificial Sequence: Synthetic oligonucleotide
taaaaaatcctgtattcgga

SEQ ID NO: 9795 - DNA, 20 bp, Artificial Sequence
  Description of Artificial Sequence: Synthetic oligonucleotide
aaaaaatcctgtattcggag

SEQ ID NO: 9796 - DNA, 20 bp, Artificial Sequence
  Description of Artificial Sequence: Synthetic oligonucleotide
aaaaatcctgtattcggaga

SEQ ID NO: 9797 - DNA, 20 bp, Artificial Sequence
  Description of Artificial Sequence: Synthetic oligonucleotide
aaaatcctgtattcggagaa

SEQ ID NO: 9798 - DNA, 20 bp, Artificial Sequence
  Description of Artificial Sequence: Synthetic oligonucleotide
aaatcctgtattcggagaaa

SEQ ID NO: 9799 - DNA, 20 bp, Artificial Sequence
  Description of Artificial Sequence: Synthetic oligonucleotide
aatcctgtattcggagaaat

SEQ ID NO: 9800 - DNA, 20 bp, Artificial Sequence
  Description of Artificial Sequence: Synthetic oligonucleotide
atcctgtattcggagaaatt

SEQ ID NO: 9801 - DNA, 20 bp, Artificial Sequence
  Description of Artificial Sequence: Synthetic oligonucleotide
tcctgtattcggagaaattc

SEQ ID NO: 9802 - DNA, 20 bp, Artificial Sequence
  Description of Artificial Sequence: Synthetic oligonucleotide
cctgtattcggagaaattca

SEQ ID NO: 9803 - DNA, 20 bp, Artificial Sequence
  Description of Artificial Sequence: Synthetic oligonucleotide
ctgtattcggagaaattcat

SEQ ID NO: 9804 - DNA, 20 bp, Artificial Sequence
  Description of Artificial Sequence: Synthetic oligonucleotide
tgtattcggagaaattcatt

SEQ ID NO: 9805 - DNA, 20 bp, Artificial Sequence
  Description of Artificial Sequence: Synthetic oligonucleotide
gtattcggagaaattcattt

SEQ ID NO: 9806 - DNA, 20 bp, Artificial Sequence
  Description of Artificial Sequence: Synthetic oligonucleotide
tattcggagaaattcattta

SEQ ID NO: 9807 - DNA, 20 bp, Artificial Sequence
  Description of Artificial Sequence: Synthetic oligonucleotide
attcggagaaattcatttaa

SEQ ID NO: 9808 - DNA, 20 bp, Artificial Sequence
  Description of Artificial Sequence: Synthetic oligonucleotide
ttcggagaaattcatttaag

SEQ ID NO: 9809 - DNA, 20 bp, Artificial Sequence
  Description of Artificial Sequence: Synthetic oligonucleotide
tcggagaaattcatttaaga

SEQ ID NO: 9810 - DNA, 20 bp, Artificial Sequence
  Description of Artificial Sequence: Synthetic oligonucleotide
cggagaaattcatttaagac

SEQ ID NO: 9811 - DNA, 20 bp, Artificial Sequence
  Description of Artificial Sequence: Synthetic oligonucleotide
ggagaaattcatttaagacc

SEQ ID NO: 9812 - DNA, 20 bp, Artificial Sequence
  Description of Artificial Sequence: Synthetic oligonucleotide
gagaaattcatttaagacca

SEQ ID NO: 9813 - DNA, 20 bp, Artificial Sequence
  Description of Artificial Sequence: Synthetic oligonucleotide
agaaattcatttaagaccat

SEQ ID NO: 9814 - DNA, 20 bp, Artificial Sequence
  Description of Artificial Sequence: Synthetic oligonucleotide
gaaattcatttaagaccatg

SEQ ID NO: 9815 - DNA, 20 bp, Artificial Sequence
  Description of Artificial Sequence: Synthetic oligonucleotide
aaattcatttaagaccatgg

SEQ ID NO: 9816 - DNA, 20 bp, Artificial Sequence
  Description of Artificial Sequence: Synthetic oligonucleotide
aattcatttaagaccatgga

SEQ ID NO: 9817 - DNA, 20 bp, Artificial Sequence
  Description of Artificial Sequence: Synthetic oligonucleotide
attcatttaagaccatggaa

SEQ ID NO: 9818 - DNA, 20 bp, Artificial Sequence
  Description of Artificial Sequence: Synthetic oligonucleotide
ttcatttaagaccatggaaa

SEQ ID NO: 9819 - DNA, 20 bp, Artificial Sequence
  Description of Artificial Sequence: Synthetic oligonucleotide
tcatttaagaccatggaaaa

SEQ ID NO: 9820 - DNA, 20 bp, Artificial Sequence
  Description of Artificial Sequence: Synthetic oligonucleotide
catttaagaccatggaaaaa

SEQ ID NO: 9821 - DNA, 20 bp, Artificial Sequence
  Description of Artificial Sequence: Synthetic oligonucleotide
atttaagaccatggaaaaaa

SEQ ID NO: 9822 - DNA, 20 bp, Artificial Sequence
  Description of Artificial Sequence: Synthetic oligonucleotide
tttaagaccatggaaaaaaa

SEQ ID NO: 9823 - DNA, 20 bp, Artificial Sequence
  Description of Artificial Sequence: Synthetic oligonucleotide
ttaagaccatggaaaaaaat

SEQ ID NO: 9824 - DNA, 20 bp, Artificial Sequence
  Description of Artificial Sequence: Synthetic oligonucleotide
taagaccatggaaaaaaata

SEQ ID NO: 9825 - DNA, 20 bp, Artificial Sequence
  Description of Artificial Sequence: Synthetic oligonucleotide
aagaccatggaaaaaaatag

SEQ ID NO: 9826 - DNA, 20 bp, Artificial Sequence
  Description of Artificial Sequence: Synthetic oligonucleotide
agaccatggaaaaaaataga

SEQ ID NO: 9827 - DNA, 20 bp, Artificial Sequence
  Description of Artificial Sequence: Synthetic oligonucleotide
gaccatggaaaaaaatagac

SEQ ID NO: 9828 - DNA, 20 bp, Artificial Sequence
  Description of Artificial Sequence: Synthetic oligonucleotide
accatggaaaaaaatagacg

SEQ ID NO: 9829 - DNA, 20 bp, Artificial Sequence
  Description of Artificial Sequence: Synthetic oligonucleotide
ccatggaaaaaaatagacgt

SEQ ID NO: 9830 - DNA, 20 bp, Artificial Sequence
  Description of Artificial Sequence: Synthetic oligonucleotide
catggaaaaaaatagacgta

SEQ ID NO: 9831 - DNA, 20 bp, Artificial Sequence
  Description of Artificial Sequence: Synthetic oligonucleotide
atggaaaaaaatagacgtat

SEQ ID NO: 9832 - DNA, 20 bp, Artificial Sequence
  Description of Artificial Sequence: Synthetic oligonucleotide
tggaaaaaaatagacgtatc

SEQ ID NO: 9833 - DNA, 20 bp, Artificial Sequence
  Description of Artificial Sequence: Synthetic oligonucleotide
ggaaaaaaatagacgtatca

SEQ ID NO: 9834 - DNA, 20 bp, Artificial Sequence
  Description of Artificial Sequence: Synthetic oligonucleotide
gaaaaaaatagacgtatcac

SEQ ID NO: 9835 - DNA, 20 bp, Artificial Sequence
  Description of Artificial Sequence: Synthetic oligonucleotide
aaaaaaatagacgtatcaca

SEQ ID NO: 9836 - DNA, 20 bp, Artificial Sequence
  Description of Artificial Sequence: Synthetic oligonucleotide
aaaaaatagacgtatcacaa

SEQ ID NO: 9837 - DNA, 20 bp, Artificial Sequence
  Description of Artificial Sequence: Synthetic oligonucleotide
aaaaatagacgtatcacaat

SEQ ID NO: 9838 - DNA, 20 bp, Artificial Sequence
  Description of Artificial Sequence: Synthetic oligonucleotide
aaaatagacgtatcacaatt

SEQ ID NO: 9839 - DNA, 20 bp, Artificial Sequence
  Description of Artificial Sequence: Synthetic oligonucleotide
aaatagacgtatcacaattg

SEQ ID NO: 9840 - DNA, 20 bp, Artificial Sequence
  Description of Artificial Sequence: Synthetic oligonucleotide
aatagacgtatcacaattga

SEQ ID NO: 9841 - DNA, 20 bp, Artificial Sequence
  Description of Artificial Sequence: Synthetic oligonucleotide
atagacgtatcacaattgag

SEQ ID NO: 9842 - DNA, 20 bp, Artificial Sequence
  Description of Artificial Sequence: Synthetic oligonucleotide
tagacgtatcacaattgagg

SEQ ID NO: 9843 - DNA, 20 bp, Artificial Sequence
  Description of Artificial Sequence: Synthetic oligonucleotide
agacgtatcacaattgagga

SEQ ID NO: 9844 - DNA, 20 bp, Artificial Sequence
  Description of Artificial Sequence: Synthetic oligonucleotide
gacgtatcacaattgaggaa

SEQ ID NO: 9845 - DNA, 20 bp, Artificial Sequence
  Description of Artificial Sequence: Synthetic oligonucleotide
acgtatcacaattgaggaac

SEQ ID NO: 9846 - DNA, 20 bp, Artificial Sequence
  Description of Artificial Sequence: Synthetic oligonucleotide
cgtatcacaattgaggaacc

SEQ ID NO: 9847 - DNA, 20 bp, Artificial Sequence
  Description of Artificial Sequence: Synthetic oligonucleotide
gtatcacaattgaggaacct

SEQ ID NO: 9848 - DNA, 20 bp, Artificial Sequence
  Description of Artificial Sequence: Synthetic oligonucleotide
tatcacaattgaggaacctt

SEQ ID NO: 9849 - DNA, 20 bp, Artificial Sequence
  Description of Artificial Sequence: Synthetic oligonucleotide
atcacaattgaggaacctta

SEQ ID NO: 9850 - DNA, 20 bp, Artificial Sequence
  Description of Artificial Sequence: Synthetic oligonucleotide
tcacaattgaggaaccttaa

SEQ ID NO: 9851 - DNA, 20 bp, Artificial Sequence
  Description of Artificial Sequence: Synthetic oligonucleotide
cacaattgaggaaccttaag

SEQ ID NO: 9852 - DNA, 20 bp, Artificial Sequence
  Description of Artificial Sequence: Synthetic oligonucleotide
acaattgaggaaccttaagg

SEQ ID NO: 9853 - DNA, 20 bp, Artificial Sequence
  Description of Artificial Sequence: Synthetic oligonucleotide
caattgaggaaccttaagga

SEQ ID NO: 9854 - DNA, 20 bp, Artificial Sequence
  Description of Artificial Sequence: Synthetic oligonucleotide
aattgaggaaccttaaggag

SEQ ID NO: 9855 - DNA, 20 bp, Artificial Sequence
  Description of Artificial Sequence: Synthetic oligonucleotide
attgaggaaccttaaggagc

SEQ ID NO: 9856 - DNA, 20 bp, Artificial Sequence
  Description of Artificial Sequence: Synthetic oligonucleotide
ttgaggaaccttaaggagcc

SEQ ID NO: 9857 - DNA, 20 bp, Artificial Sequence
  Description of Artificial Sequence: Synthetic oligonucleotide
tgaggaaccttaaggagccg

SEQ ID NO: 9858 - DNA, 20 bp, Artificial Sequence
  Description of Artificial Sequence: Synthetic oligonucleotide
gaggaaccttaaggagccgc

SEQ ID NO: 9859 - DNA, 20 bp, Artificial Sequence
  Description of Artificial Sequence: Synthetic oligonucleotide
aggaaccttaaggagccgca

SEQ ID NO: 9860 - DNA, 20 bp, Artificial Sequence
  Description of Artificial Sequence: Synthetic oligonucleotide
ggaaccttaaggagccgcat

SEQ ID NO: 9861 - DNA, 20 bp, Artificial Sequence
  Description of Artificial Sequence: Synthetic oligonucleotide
gaaccttaaggagccgcatc

SEQ ID NO: 9862 - DNA, 20 bp, Artificial Sequence
  Description of Artificial Sequence: Synthetic oligonucleotide
aaccttaaggagccgcatcc

SEQ ID NO: 9863 - DNA, 20 bp, Artificial Sequence
  Description of Artificial Sequence: Synthetic oligonucleotide
accttaaggagccgcatcct

SEQ ID NO: 9864 - DNA, 20 bp, Artificial Sequence
  Description of Artificial Sequence: Synthetic oligonucleotide
ccttaaggagccgcatcctt

SEQ ID NO: 9865 - DNA, 20 bp, Artificial Sequence
  Description of Artificial Sequence: Synthetic oligonucleotide
cttaaggagccgcatccttc

SEQ ID NO: 9866 - DNA, 20 bp, Artificial Sequence
  Description of Artificial Sequence: Synthetic oligonucleotide
ttaaggagccgcatccttcc

SEQ ID NO: 9867 - DNA, 20 bp, Artificial Sequence
  Description of Artificial Sequence: Synthetic oligonucleotide
taaggagccgcatccttcct

SEQ ID NO: 9868 - DNA, 20 bp, Artificial Sequence
  Description of Artificial Sequence: Synthetic oligonucleotide
aaggagccgcatccttcctg

SEQ ID NO: 9869 - DNA, 20 bp, Artificial Sequence
  Description of Artificial Sequence: Synthetic oligonucleotide
aggagccgcatccttcctga

SEQ ID NO: 9870 - DNA, 20 bp, Artificial Sequence
  Description of Artificial Sequence: Synthetic oligonucleotide
ggagccgcatccttcctgaa

SEQ ID NO: 9871 - DNA, 20 bp, Artificial Sequence
  Description of Artificial Sequence: Synthetic oligonucleotide
gagccgcatccttcctgaac

SEQ ID NO: 9872 - DNA, 20 bp, Artificial Sequence
  Description of Artificial Sequence: Synthetic oligonucleotide
agccgcatccttcctgaaca

SEQ ID NO: 9873 - DNA, 20 bp, Artificial Sequence
  Description of Artificial Sequence: Synthetic oligonucleotide
gccgcatccttcctgaacac

SEQ ID NO: 9874 - DNA, 20 bp, Artificial Sequence
  Description of Artificial Sequence: Synthetic oligonucleotide
ccgcatccttcctgaacaca

SEQ ID NO: 9875 - DNA, 20 bp, Artificial Sequence
  Description of Artificial Sequence: Synthetic oligonucleotide
cgcatccttcctgaacacaa

SEQ ID NO: 9876 - DNA, 20 bp, Artificial Sequence
  Description of Artificial Sequence: Synthetic oligonucleotide
gcatccttcctgaacacaaa

SEQ ID NO: 9877 - DNA, 20 bp, Artificial Sequence
  Description of Artificial Sequence: Synthetic oligonucleotide
catccttcctgaacacaaag

SEQ ID NO: 9878 - DNA, 20 bp, Artificial Sequence
  Description of Artificial Sequence: Synthetic oligonucleotide
atccttcctgaacacaaagg

SEQ ID NO: 9879 - DNA, 20 bp, Artificial Sequence
  Description of Artificial Sequence: Synthetic oligonucleotide
tccttcctgaacacaaaggg

SEQ ID NO: 9880 - DNA, 20 bp, Artificial Sequence
  Description of Artificial Sequence: Synthetic oligonucleotide
ccttcctgaacacaaaggga

SEQ ID NO: 9881 - DNA, 20 bp, Artificial Sequence
  Description of Artificial Sequence: Synthetic oligonucleotide
cttcctgaacacaaagggac

SEQ ID NO: 9882 - DNA, 20 bp, Artificial Sequence
  Description of Artificial Sequence: Synthetic oligonucleotide
ttcctgaacacaaagggact

SEQ ID NO: 9883 - DNA, 20 bp, Artificial Sequence
  Description of Artificial Sequence: Synthetic oligonucleotide
tcctgaacacaaagggactc

SEQ ID NO: 9884 - DNA, 20 bp, Artificial Sequence
  Description of Artificial Sequence: Synthetic oligonucleotide
cctgaacacaaagggactct

SEQ ID NO: 9885 - DNA, 20 bp, Artificial Sequence
  Description of Artificial Sequence: Synthetic oligonucleotide
ctgaacacaaagggactctt

SEQ ID NO: 9886 - DNA, 20 bp, Artificial Sequence
  Description of Artificial Sequence: Synthetic oligonucleotide
tgaacacaaagggactcttc

SEQ ID NO: 9887 - DNA, 20 bp, Artificial Sequence
  Description of Artificial Sequence: Synthetic oligonucleotide
gaacacaaagggactcttca

SEQ ID NO: 9888 - DNA, 20 bp, Artificial Sequence
  Description of Artificial Sequence: Synthetic oligonucleotide
aacacaaagggactcttcac

SEQ ID NO: 9889 - DNA, 20 bp, Artificial Sequence
  Description of Artificial Sequence: Synthetic oligonucleotide
acacaaagggactcttcaca

SEQ ID NO: 9890 - DNA, 20 bp, Artificial Sequence
  Description of Artificial Sequence: Synthetic oligonucleotide
cacaaagggactcttcacat

SEQ ID NO: 9891 - DNA, 20 bp, Artificial Sequence
  Description of Artificial Sequence: Synthetic oligonucleotide
acaaagggactcttcacatg

SEQ ID NO: 9892 - DNA, 20 bp, Artificial Sequence
  Description of Artificial Sequence: Synthetic oligonucleotide
caaagggactcttcacatgg

SEQ ID NO: 9893 - DNA, 20 bp, Artificial Sequence
  Description of Artificial Sequence: Synthetic oligonucleotide
aaagggactcttcacatggt

SEQ ID NO: 9894 - DNA, 20 bp, Artificial Sequence
  Description of Artificial Sequence: Synthetic oligonucleotide
aagggactcttcacatggtt

SEQ ID NO: 9895 - DNA, 20 bp, Artificial Sequence
  Description of Artificial Sequence: Synthetic oligonucleotide
agggactcttcacatggtta

SEQ ID NO: 9896 - DNA, 20 bp, Artificial Sequence
  Description of Artificial Sequence: Synthetic oligonucleotide
gggactcttcacatggttat

SEQ ID NO: 9897 - DNA, 20 bp, Artificial Sequence
  Description of Artificial Sequence: Synthetic oligonucleotide
ggactcttcacatggttatg

SEQ ID NO: 9898 - DNA, 20 bp, Artificial Sequence
  Description of Artificial Sequence: Synthetic oligonucleotide
gactcttcacatggttatgt

SEQ ID NO: 9899 - DNA, 20 bp, Artificial Sequence
  Description of Artificial Sequence: Synthetic oligonucleotide
actcttcacatggttatgtg

SEQ ID NO: 9900 - DNA, 20 bp, Artificial Sequence
  Description of Artificial Sequence: Synthetic oligonucleotide
ctcttcacatggttatgtgt

SEQ ID NO: 9901 - DNA, 20 bp, Artificial Sequence
  Description of Artificial Sequence: Synthetic oligonucleotide
tcttcacatggttatgtgtc

SEQ ID NO: 9902 - DNA, 20 bp, Artificial Sequence
  Description of Artificial Sequence: Synthetic oligonucleotide
cttcacatggttatgtgtct

SEQ ID NO: 9903 - DNA, 20 bp, Artificial Sequence
  Description of Artificial Sequence: Synthetic oligonucleotide
ttcacatggttatgtgtctc

SEQ ID NO: 9904 - DNA, 20 bp, Artificial Sequence
  Description of Artificial Sequence: Synthetic oligonucleotide
tcacatggttatgtgtctct

SEQ ID NO: 9905 - DNA, 20 bp, Artificial Sequence
  Description of Artificial Sequence: Synthetic oligonucleotide
cacatggttatgtgtctcta

SEQ ID NO: 9906 - DNA, 20 bp, Artificial Sequence
  Description of Artificial Sequence: Synthetic oligonucleotide
acatggttatgtgtctctac

SEQ ID NO: 9907 - DNA, 20 bp, Artificial Sequence
  Description of Artificial Sequence: Synthetic oligonucleotide
catggttatgtgtctctaca

SEQ ID NO: 9908 - DNA, 20 bp, Artificial Sequence
  Description of Artificial Sequence: Synthetic oligonucleotide
atggttatgtgtctctacac

SEQ ID NO: 9909 - DNA, 20 bp, Artificial Sequence
  Description of Artificial Sequence: Synthetic oligonucleotide
tggttatgtgtctctacact

SEQ ID NO: 9910 - DNA, 20 bp, Artificial Sequence
  Description of Artificial Sequence: Synthetic oligonucleotide
ggttatgtgtctctacactt

SEQ ID NO: 9911 - DNA, 20 bp, Artificial Sequence
  Description of Artificial Sequence: Synthetic oligonucleotide
gttatgtgtctctacactta

SEQ ID NO: 9912 - DNA, 20 bp, Artificial Sequence
  Description of Artificial Sequence: Synthetic oligonucleotide
ttatgtgtctctacacttaa

SEQ ID NO: 9913 - DNA, 20 bp, Artificial Sequence
  Description of Artificial Sequence: Synthetic oligonucleotide
tatgtgtctctacacttaac

SEQ ID NO: 9914 - DNA, 20 bp, Artificial Sequence
  Description of Artificial Sequence: Synthetic oligonucleotide
atgtgtctctacacttaact

SEQ ID NO: 9915 - DNA, 20 bp, Artificial Sequence
  Description of Artificial Sequence: Synthetic oligonucleotide
tgtgtctctacacttaactc

SEQ ID NO: 9916 - DNA, 20 bp, Artificial Sequence
  Description of Artificial Sequence: Synthetic oligonucleotide
gtgtctctacacttaactct

SEQ ID NO: 9917 - DNA, 20 bp, Artificial Sequence
  Description of Artificial Sequence: Synthetic oligonucleotide
tgtctctacacttaactctg

SEQ ID NO: 9918 - DNA, 20 bp, Artificial Sequence
  Description of Artificial Sequence: Synthetic oligonucleotide
gtctctacacttaactctga

SEQ ID NO: 9919 - DNA, 20 bp, Artificial Sequence
  Description of Artificial Sequence: Synthetic oligonucleotide
tctctacacttaactctgag

SEQ ID NO: 9920 - DNA, 20 bp, Artificial Sequence
  Description of Artificial Sequence: Synthetic oligonucleotide
ctctacacttaactctgagc

SEQ ID NO: 9921 - DNA, 20 bp, Artificial Sequence
  Description of Artificial Sequence: Synthetic oligonucleotide
tctacacttaactctgagcc

SEQ ID NO: 9922 - DNA, 20 bp, Artificial Sequence
  Description of Artificial Sequence: Synthetic oligonucleotide
ctacacttaactctgagcca

SEQ ID NO: 9923 - DNA, 20 bp, Artificial Sequence
  Description of Artificial Sequence: Synthetic oligonucleotide
tacacttaactctgagccaa

SEQ ID NO: 9924 - DNA, 20 bp, Artificial Sequence
  Description of Artificial Sequence: Synthetic oligonucleotide
acacttaactctgagccaat

SEQ ID NO: 9925 - DNA, 20 bp, Artificial Sequence
  Description of Artificial Sequence: Synthetic oligonucleotide
cacttaactctgagccaatg

SEQ ID NO: 9926 - DNA, 20 bp, Artificial Sequence
  Description of Artificial Sequence: Synthetic oligonucleotide
acttaactctgagccaatga

SEQ ID NO: 9927 - DNA, 20 bp, Artificial Sequence
  Description of Artificial Sequence: Synthetic oligonucleotide
cttaactctgagccaatgag

SEQ ID NO: 9928 - DNA, 20 bp, Artificial Sequence
  Description of Artificial Sequence: Synthetic oligonucleotide
ttaactctgagccaatgaga

SEQ ID NO: 9929 - DNA, 20 bp, Artificial Sequence
  Description of Artificial Sequence: Synthetic oligonucleotide
taactctgagccaatgagaa

SEQ ID NO: 9930 - DNA, 20 bp, Artificial Sequence
  Description of Artificial Sequence: Synthetic oligonucleotide
aactctgagccaatgagaag

SEQ ID NO: 9931 - DNA, 20 bp, Artificial Sequence
  Description of Artificial Sequence: Synthetic oligonucleotide
actctgagccaatgagaaga

SEQ ID NO: 9932 - DNA, 20 bp, Artificial Sequence
  Description of Artificial Sequence: Synthetic oligonucleotide
ctctgagccaatgagaagag

SEQ ID NO: 9933 - DNA, 20 bp, Artificial Sequence
  Description of Artificial Sequence: Synthetic oligonucleotide
tctgagccaatgagaagagt

SEQ ID NO: 9934 - DNA, 20 bp, Artificial Sequence
  Description of Artificial Sequence: Synthetic oligonucleotide
ctgagccaatgagaagagtt

SEQ ID NO: 9935 - DNA, 20 bp, Artificial Sequence
  Description of Artificial Sequence: Synthetic oligonucleotide
tgagccaatgagaagagtta

SEQ ID NO: 9936 - DNA, 20 bp, Artificial Sequence
  Description of Artificial Sequence: Synthetic oligonucleotide
gagccaatgagaagagttac

SEQ ID NO: 9937 - DNA, 20 bp, Artificial Sequence
  Description of Artificial Sequence: Synthetic oligonucleotide
agccaatgagaagagttacg

SEQ ID NO: 9938 - DNA, 20 bp, Artificial Sequence
  Description of Artificial Sequence: Synthetic oligonucleotide
gccaatgagaagagttacgt

SEQ ID NO: 9939 - DNA, 20 bp, Artificial Sequence
  Description of Artificial Sequence: Synthetic oligonucleotide
ccaatgagaagagttacgtt

SEQ ID NO: 9940 - DNA, 20 bp, Artificial Sequence
  Description of Artificial Sequence: Synthetic oligonucleotide
caatgagaagagttacgttt

SEQ ID NO: 9941 - DNA, 20 bp, Artificial Sequence
  Description of Artificial Sequence: Synthetic oligonucleotide
aatgagaagagttacgttta

SEQ ID NO: 9942 - DNA, 20 bp, Artificial Sequence
  Description of Artificial Sequence: Synthetic oligonucleotide
atgagaagagttacgtttac

SEQ ID NO: 9943 - DNA, 20 bp, Artificial Sequence
  Description of Artificial Sequence: Synthetic oligonucleotide
tgagaagagttacgtttaca

SEQ ID NO: 9944 - DNA, 20 bp, Artificial Sequence
  Description of Artificial Sequence: Synthetic oligonucleotide
gagaagagttacgtttacag

SEQ ID NO: 9945 - DNA, 20 bp, Artificial Sequence
  Description of Artificial Sequence: Synthetic oligonucleotide
agaagagttacgtttacaga

SEQ ID NO: 9946 - DNA, 20 bp, Artificial Sequence
  Description of Artificial Sequence: Synthetic oligonucleotide
gaagagttacgtttacagag

SEQ ID NO: 9947 - DNA, 20 bp, Artificial Sequence
  Description of Artificial Sequence: Synthetic oligonucleotide
aagagttacgtttacagaga

SEQ ID NO: 9948 - DNA, 20 bp, Artificial Sequence
  Description of Artificial Sequence: Synthetic oligonucleotide
agagttacgtttacagagag

SEQ ID NO: 9949 - DNA, 20 bp, Artificial Sequence
  Description of Artificial Sequence: Synthetic oligonucleotide
gagttacgtttacagagaga

SEQ ID NO: 9950 - DNA, 20 bp, Artificial Sequence
  Description of Artificial Sequence: Synthetic oligonucleotide
agttacgtttacagagagag

SEQ ID NO: 9951 - DNA, 20 bp, Artificial Sequence
  Description of Artificial Sequence: Synthetic oligonucleotide
gttacgtttacagagagagg

SEQ ID NO: 9952 - DNA, 20 bp, Artificial Sequence
  Description of Artificial Sequence: Synthetic oligonucleotide
ttacgtttacagagagagga

SEQ ID NO: 9953 - DNA, 20 bp, Artificial Sequence
  Description of Artificial Sequence: Synthetic oligonucleotide
tacgtttacagagagaggac

SEQ ID NO: 9954 - DNA, 20 bp, Artificial Sequence
  Description of Artificial Sequence: Synthetic oligonucleotide
acgtttacagagagaggaca

SEQ ID NO: 9955 - DNA, 20 bp, Artificial Sequence
  Description of Artificial Sequence: Synthetic oligonucleotide
cgtttacagagagaggacac

SEQ ID NO: 9956 - DNA, 20 bp, Artificial Sequence
  Description of Artificial Sequence: Synthetic oligonucleotide
gtttacagagagaggacaca

SEQ ID NO: 9957 - DNA, 20 bp, Artificial Sequence
  Description of Artificial Sequence: Synthetic oligonucleotide
tttacagagagaggacacaa

SEQ ID NO: 9958 - DNA, 20 bp, Artificial Sequence
  Description of Artificial Sequence: Synthetic oligonucleotide
ttacagagagaggacacaaa

SEQ ID NO: 9959 - DNA, 20 bp, Artificial Sequence
  Description of Artificial Sequence: Synthetic oligonucleotide
tacagagagaggacacaaaa

SEQ ID NO: 9960 - DNA, 20 bp, Artificial Sequence
  Description of Artificial Sequence: Synthetic oligonucleotide
acagagagaggacacaaaat

SEQ ID NO: 9961 - DNA, 20 bp, Artificial Sequence
  Description of Artificial Sequence: Synthetic oligonucleotide
cagagagaggacacaaaatt

SEQ ID NO: 9962 - DNA, 20 bp, Artificial Sequence
  Description of Artificial Sequence: Synthetic oligonucleotide
agagagaggacacaaaattc

SEQ ID NO: 9963 - DNA, 20 bp, Artificial Sequence
  Description of Artificial Sequence: Synthetic oligonucleotide
gagagaggacacaaaattcc

SEQ ID NO: 9964 - DNA, 20 bp, Artificial Sequence
  Description of Artificial Sequence: Synthetic oligonucleotide
agagaggacacaaaattcca

SEQ ID NO: 9965 - DNA, 20 bp, Artificial Sequence
  Description of Artificial Sequence: Synthetic oligonucleotide
gagaggacacaaaattccat

SEQ ID NO: 9966 - DNA, 20 bp, Artificial Sequence
  Description of Artificial Sequence: Synthetic oligonucleotide
agaggacacaaaattccatt

SEQ ID NO: 9967 - DNA, 20 bp, Artificial Sequence
  Description of Artificial Sequence: Synthetic oligonucleotide
gaggacacaaaattccatta

SEQ ID NO: 9968 - DNA, 20 bp, Artificial Sequence
  Description of Artificial Sequence: Synthetic oligonucleotide
aggacacaaaattccattaa

SEQ ID NO: 9969 - DNA, 20 bp, Artificial Sequence
  Description of Artificial Sequence: Synthetic oligonucleotide
ggacacaaaattccattaat

SEQ ID NO: 9970 - DNA, 20 bp, Artificial Sequence
  Description of Artificial Sequence: Synthetic oligonucleotide
gacacaaaattccattaatg

SEQ ID NO: 9971 - DNA, 20 bp, Artificial Sequence
  Description of Artificial Sequence: Synthetic oligonucleotide
acacaaaattccattaatgc

SEQ ID NO: 9972 - DNA, 20 bp, Artificial Sequence
  Description of Artificial Sequence: Synthetic oligonucleotide
cacaaaattccattaatgct

SEQ ID NO: 9973 - DNA, 20 bp, Artificial Sequence
  Description of Artificial Sequence: Synthetic oligonucleotide
acaaaattccattaatgctc

SEQ ID NO: 9974 - DNA, 20 bp, Artificial Sequence
  Description of Artificial Sequence: Synthetic oligonucleotide
caaaattccattaatgctca

SEQ ID NO: 9975 - DNA, 20 bp, Artificial Sequence
  Description of Artificial Sequence: Synthetic oligonucleotide
aaaattccattaatgctcat

SEQ ID NO: 9976 - DNA, 20 bp, Artificial Sequence
  Description of Artificial Sequence: Synthetic oligonucleotide
aaattccattaatgctcatt

SEQ ID NO: 9977 - DNA, 20 bp, Artificial Sequence
  Description of Artificial Sequence: Synthetic oligonucleotide
aattccattaatgctcattc

SEQ ID NO: 9978 - DNA, 20 bp, Artificial Sequence
  Description of Artificial Sequence: Synthetic oligonucleotide
attccattaatgctcattcc

SEQ ID NO: 9979 - DNA, 20 bp, Artificial Sequence
  Description of Artificial Sequence: Synthetic oligonucleotide
ttccattaatgctcattcct

SEQ ID NO: 9980 - DNA, 20 bp, Artificial Sequence
  Description of Artificial Sequence: Synthetic oligonucleotide
tccattaatgctcattcctg

SEQ ID NO: 9981 - DNA, 20 bp, Artificial Sequence
  Description of Artificial Sequence: Synthetic oligonucleotide
ccattaatgctcattcctgg

SEQ ID NO: 9982 - DNA, 20 bp, Artificial Sequence
  Description of Artificial Sequence: Synthetic oligonucleotide
cattaatgctcattcctggt

SEQ ID NO: 9983 - DNA, 20 bp, Artificial Sequence
  Description of Artificial Sequence: Synthetic oligonucleotide
attaatgctcattcctggta

SEQ ID NO: 9984 - DNA, 20 bp, Artificial Sequence
  Description of Artificial Sequence: Synthetic oligonucleotide
ttaatgctcattcctggtaa

SEQ ID NO: 9985 - DNA, 20 bp, Artificial Sequence
  Description of Artificial Sequence: Synthetic oligonucleotide
taatgctcattcctggtaaa

SEQ ID NO: 9986 - DNA, 20 bp, Artificial Sequence
  Description of Artificial Sequence: Synthetic oligonucleotide
aatgctcattcctggtaaat

SEQ ID NO: 9987 - DNA, 20 bp, Artificial Sequence
  Description of Artificial Sequence: Synthetic oligonucleotide
atgctcattcctggtaaatc

SEQ ID NO: 9988 - DNA, 20 bp, Artificial Sequence
  Description of Artificial Sequence: Synthetic oligonucleotide
tgctcattcctggtaaatct

SEQ ID NO: 9989 - DNA, 20 bp, Artificial Sequence
  Description of Artificial Sequence: Synthetic oligonucleotide
gctcattcctggtaaatctt

SEQ ID NO: 9990 - DNA, 20 bp, Artificial Sequence
  Description of Artificial Sequence: Synthetic oligonucleotide
ctcattcctggtaaatctta

SEQ ID NO: 9991 - DNA, 20 bp, Artificial Sequence
  Description of Artificial Sequence: Synthetic oligonucleotide
tcattcctggtaaatcttag

SEQ ID NO: 9992 - DNA, 20 bp, Artificial Sequence
  Description of Artificial Sequence: Synthetic oligonucleotide
cattcctggtaaatcttagg

SEQ ID NO: 9993 - DNA, 20 bp, Artificial Sequence
  Description of Artificial Sequence: Synthetic oligonucleotide
attcctggtaaatcttagga

SEQ ID NO: 9994 - DNA, 20 bp, Artificial Sequence
  Description of Artificial Sequence: Synthetic oligonucleotide
ttcctggtaaatcttaggaa

SEQ ID NO: 9995 - DNA, 20 bp, Artificial Sequence
  Description of Artificial Sequence: Synthetic oligonucleotide
tcctggtaaatcttaggaac

SEQ ID NO: 9996 - DNA, 20 bp, Artificial Sequence
  Description of Artificial Sequence: Synthetic oligonucleotide
cctggtaaatcttaggaaca

SEQ ID NO: 9997 - DNA, 20 bp, Artificial Sequence
  Description of Artificial Sequence: Synthetic oligonucleotide
ctggtaaatcttaggaacac

SEQ ID NO: 9998 - DNA, 20 bp, Artificial Sequence
  Description of Artificial Sequence: Synthetic oligonucleotide
tggtaaatcttaggaacacc

SEQ ID NO: 9999 - DNA, 20 bp, Artificial Sequence
  Description of Artificial Sequence: Synthetic oligonucleotide
ggtaaatcttaggaacacca

SEQ ID NO: 10000 - DNA, 20 bp, Artificial Sequence
  Description of Artificial Sequence: Synthetic oligonucleotide
gtaaatcttaggaacaccag

SEQ ID NO: 10001 - DNA, 20 bp, Artificial Sequence
  Description of Artificial Sequence: Synthetic oligonucleotide
taaatcttaggaacaccaga

SEQ ID NO: 10002 - DNA, 20 bp, Artificial Sequence
  Description of Artificial Sequence: Synthetic oligonucleotide
aaatcttaggaacaccagag

SEQ ID NO: 10003 - DNA, 20 bp, Artificial Sequence
  Description of Artificial Sequence: Synthetic oligonucleotide
aatcttaggaacaccagaga

SEQ ID NO: 10004 - DNA, 20 bp, Artificial Sequence
  Description of Artificial Sequence: Synthetic oligonucleotide
atcttaggaacaccagagaa

SEQ ID NO: 10005 - DNA, 20 bp, Artificial Sequence
  Description of Artificial Sequence: Synthetic oligonucleotide
tcttaggaacaccagagaac

SEQ ID NO: 10006 - DNA, 20 bp, Artificial Sequence
  Description of Artificial Sequence: Synthetic oligonucleotide
cttaggaacaccagagaact

SEQ ID NO: 10007 - DNA, 20 bp, Artificial Sequence
  Description of Artificial Sequence: Synthetic oligonucleotide
ttaggaacaccagagaactg

SEQ ID NO: 10008 - DNA, 20 bp, Artificial Sequence
  Description of Artificial Sequence: Synthetic oligonucleotide
taggaacaccagagaactgt

SEQ ID NO: 10009 - DNA, 20 bp, Artificial Sequence
  Description of Artificial Sequence: Synthetic oligonucleotide
aggaacaccagagaactgtt

SEQ ID NO: 10010 - DNA, 20 bp, Artificial Sequence
  Description of Artificial Sequence: Synthetic oligonucleotide
ggaacaccagagaactgttt

SEQ ID NO: 10011 - DNA, 20 bp, Artificial Sequence
  Description of Artificial Sequence: Synthetic oligonucleotide
gaacaccagagaactgtttc

SEQ ID NO: 10012 - DNA, 20 bp, Artificial Sequence
  Description of Artificial Sequence: Synthetic oligonucleotide
aacaccagagaactgtttct

SEQ ID NO: 10013 - DNA, 20 bp, Artificial Sequence
  Description of Artificial Sequence: Synthetic oligonucleotide
acaccagagaactgtttctg

SEQ ID NO: 10014 - DNA, 20 bp, Artificial Sequence
  Description of Artificial Sequence: Synthetic oligonucleotide
caccagagaactgtttctgg

SEQ ID NO: 10015 - DNA, 20 bp, Artificial Sequence
  Description of Artificial Sequence: Synthetic oligonucleotide
accagagaactgtttctggc

SEQ ID NO: 10016 - DNA, 20 bp, Artificial Sequence
  Description of Artificial Sequence: Synthetic oligonucleotide
ccagagaactgtttctggca

SEQ ID NO: 10017 - DNA, 20 bp, Artificial Sequence
  Description of Artificial Sequence: Synthetic oligonucleotide
cagagaactgtttctggcaa

SEQ ID NO: 10018 - DNA, 20 bp, Artificial Sequence
  Description of Artificial Sequence: Synthetic oligonucleotide
agagaactgtttctggcaaa

SEQ ID NO: 10019 - DNA, 20 bp, Artificial Sequence
  Description of Artificial Sequence: Synthetic oligonucleotide
gagaactgtttctggcaaaa

SEQ ID NO: 10020 - DNA, 20 bp, Artificial Sequence
  Description of Artificial Sequence: Synthetic oligonucleotide
agaactgtttctggcaaaac

SEQ ID NO: 10021 - DNA, 20 bp, Artificial Sequence
  Description of Artificial Sequence: Synthetic oligonucleotide
gaactgtttctggcaaaact

SEQ ID NO: 10022 - DNA, 20 bp, Artificial Sequence
  Description of Artificial Sequence: Synthetic oligonucleotide
aactgtttctggcaaaactt

SEQ ID NO: 10023 - DNA, 20 bp, Artificial Sequence
  Description of Artificial Sequence: Synthetic oligonucleotide
actgtttctggcaaaacttt

SEQ ID NO: 10024 - DNA, 20 bp, Artificial Sequence
  Description of Artificial Sequence: Synthetic oligonucleotide
ctgtttctggcaaaactttg

SEQ ID NO: 10025 - DNA, 20 bp, Artificial Sequence
  Description of Artificial Sequence: Synthetic oligonucleotide
tgtttctggcaaaactttgc

SEQ ID NO: 10026 - DNA, 20 bp, Artificial Sequence
  Description of Artificial Sequence: Synthetic oligonucleotide
gtttctggcaaaactttgct

SEQ ID NO: 10027 - DNA, 20 bp, Artificial Sequence
  Description of Artificial Sequence: Synthetic oligonucleotide
tttctggcaaaactttgctt

SEQ ID NO: 10028 - DNA, 20 bp, Artificial Sequence
  Description of Artificial Sequence: Synthetic oligonucleotide
ttctggcaaaactttgcttc

SEQ ID NO: 10029 - DNA, 20 bp, Artificial Sequence
  Description of Artificial Sequence: Synthetic oligonucleotide
tctggcaaaactttgcttcc

SEQ ID NO: 10030 - DNA, 20 bp, Artificial Sequence
  Description of Artificial Sequence: Synthetic oligonucleotide
ctggcaaaactttgcttcca

SEQ ID NO: 10031 - DNA, 20 bp, Artificial Sequence
  Description of Artificial Sequence: Synthetic oligonucleotide
tggcaaaactttgcttccag

SEQ ID NO: 10032 - DNA, 20 bp, Artificial Sequence
  Description of Artificial Sequence: Synthetic oligonucleotide
ggcaaaactttgcttccaga

SEQ ID NO: 10033 - DNA, 20 bp, Artificial Sequence
  Description of Artificial Sequence: Synthetic oligonucleotide
gcaaaactttgcttccagag

SEQ ID NO: 10034 - DNA, 20 bp, Artificial Sequence
  Description of Artificial Sequence: Synthetic oligonucleotide
caaaactttgcttccagagg

SEQ ID NO: 10035 - DNA, 20 bp, Artificial Sequence
  Description of Artificial Sequence: Synthetic oligonucleotide
aaaactttgcttccagagga

SEQ ID NO: 10036 - DNA, 20 bp, Artificial Sequence
  Description of Artificial Sequence: Synthetic oligonucleotide
aaactttgcttccagaggaa

SEQ ID NO: 10037 - DNA, 20 bp, Artificial Sequence
  Description of Artificial Sequence: Synthetic oligonucleotide
aactttgcttccagaggaac

SEQ ID NO: 10038 - DNA, 20 bp, Artificial Sequence
  Description of Artificial Sequence: Synthetic oligonucleotide
actttgcttccagaggaaca

SEQ ID NO: 10039 - DNA, 20 bp, Artificial Sequence
  Description of Artificial Sequence: Synthetic oligonucleotide
ctttgcttccagaggaacag

SEQ ID NO: 10040 - DNA, 20 bp, Artificial Sequence
  Description of Artificial Sequence: Synthetic oligonucleotide
tttgcttccagaggaacagc

SEQ ID NO: 10041 - DNA, 20 bp, Artificial Sequence
  Description of Artificial Sequence: Synthetic oligonucleotide
ttgcttccagaggaacagct

SEQ ID NO: 10042 - DNA, 20 bp, Artificial Sequence
  Description of Artificial Sequence: Synthetic oligonucleotide
tgcttccagaggaacagctg

SEQ ID NO: 10043 - DNA, 20 bp, Artificial Sequence
  Description of Artificial Sequence: Synthetic oligonucleotide
gcttccagaggaacagctgt

SEQ ID NO: 10044 - DNA, 20 bp, Artificial Sequence
  Description of Artificial Sequence: Synthetic oligonucleotide
cttccagaggaacagctgtt

SEQ ID NO: 10045 - DNA, 20 bp, Artificial Sequence
  Description of Artificial Sequence: Synthetic oligonucleotide
ttccagaggaacagctgtta

SEQ ID NO: 10046 - DNA, 20 bp, Artificial Sequence
  Description of Artificial Sequence: Synthetic oligonucleotide
tccagaggaacagctgttac

SEQ ID NO: 10047 - DNA, 20 bp, Artificial Sequence
  Description of Artificial Sequence: Synthetic oligonucleotide
ccagaggaacagctgttaca

SEQ ID NO: 10048 - DNA, 20 bp, Artificial Sequence
  Description of Artificial Sequence: Synthetic oligonucleotide
cagaggaacagctgttacag

SEQ ID NO: 10049 - DNA, 20 bp, Artificial Sequence
  Description of Artificial Sequence: Synthetic oligonucleotide
agaggaacagctgttacagt

SEQ ID NO: 10050 - DNA, 20 bp, Artificial Sequence
  Description of Artificial Sequence: Synthetic oligonucleotide
gaggaacagctgttacagtt

SEQ ID NO: 10051 - DNA, 20 bp, Artificial Sequence
  Description of Artificial Sequence: Synthetic oligonucleotide
aggaacagctgttacagttt

SEQ ID NO: 10052 - DNA, 20 bp, Artificial Sequence
  Description of Artificial Sequence: Synthetic oligonucleotide
ggaacagctgttacagtttg

SEQ ID NO: 10053 - DNA, 20 bp, Artificial Sequence
  Description of Artificial Sequence: Synthetic oligonucleotide
gaacagctgttacagtttgg

SEQ ID NO: 10054 - DNA, 20 bp, Artificial Sequence
  Description of Artificial Sequence: Synthetic oligonucleotide
aacagctgttacagtttggt

SEQ ID NO: 10055 - DNA, 20 bp, Artificial Sequence
  Description of Artificial Sequence: Synthetic oligonucleotide
acagctgttacagtttggtg

SEQ ID NO: 10056 - DNA, 20 bp, Artificial Sequence
  Description of Artificial Sequence: Synthetic oligonucleotide
cagctgttacagtttggtgc

SEQ ID NO: 10057 - DNA, 20 bp, Artificial Sequence
  Description of Artificial Sequence: Synthetic oligonucleotide
agctgttacagtttggtgct

SEQ ID NO: 10058 - DNA, 20 bp, Artificial Sequence
  Description of Artificial Sequence: Synthetic oligonucleotide
gctgttacagtttggtgctt

SEQ ID NO: 10059 - DNA, 20 bp, Artificial Sequence
  Description of Artificial Sequence: Synthetic oligonucleotide
ctgttacagtttggtgcttc

SEQ ID NO: 10060 - DNA, 20 bp, Artificial Sequence
  Description of Artificial Sequence: Synthetic oligonucleotide
tgttacagtttggtgcttcc

SEQ ID NO: 10061 - DNA, 20 bp, Artificial Sequence
  Description of Artificial Sequence: Synthetic oligonucleotide
gttacagtttggtgcttcct

SEQ ID NO: 10062 - DNA, 20 bp, Artificial Sequence
  Description of Artificial Sequence: Synthetic oligonucleotide
ttacagtttggtgcttcctt

SEQ ID NO: 10063 - DNA, 20 bp, Artificial Sequence
  Description of Artificial Sequence: Synthetic oligonucleotide
tacagtttggtgcttccttg

SEQ ID NO: 10064 - DNA, 20 bp, Artificial Sequence
  Description of Artificial Sequence: Synthetic oligonucleotide
acagtttggtgcttccttgg

SEQ ID NO: 10065 - DNA, 20 bp, Artificial Sequence
  Description of Artificial Sequence: Synthetic oligonucleotide
cagtttggtgcttccttgga

SEQ ID NO: 10066 - DNA, 20 bp, Artificial Sequence
  Description of Artificial Sequence: Synthetic oligonucleotide
agtttggtgcttccttggaa

SEQ ID NO: 10067 - DNA, 20 bp, Artificial Sequence
  Description of Artificial Sequence: Synthetic oligonucleotide
gtttggtgcttccttggaat

SEQ ID NO: 10068 - DNA, 20 bp, Artificial Sequence
  Description of Artificial Sequence: Synthetic oligonucleotide
tttggtgcttccttggaatt

SEQ ID NO: 10069 - DNA, 20 bp, Artificial Sequence
  Description of Artificial Sequence: Synthetic oligonucleotide
ttggtgcttccttggaattt

SEQ ID NO: 10070 - DNA, 20 bp, Artificial Sequence
  Description of Artificial Sequence: Synthetic oligonucleotide
tggtgcttccttggaatttc

SEQ ID NO: 10071 - DNA, 20 bp, Artificial Sequence
  Description of Artificial Sequence: Synthetic oligonucleotide
ggtgcttccttggaatttct

SEQ ID NO: 10072 - DNA, 20 bp, Artificial Sequence
  Description of Artificial Sequence: Synthetic oligonucleotide
gtgcttccttggaatttctt

SEQ ID NO: 10073 - DNA, 20 bp, Artificial Sequence
  Description of Artificial Sequence: Synthetic oligonucleotide
tgcttccttggaatttcttg

SEQ ID NO: 10074 - DNA, 20 bp, Artificial Sequence
  Description of Artificial Sequence: Synthetic oligonucleotide
gcttccttggaatttcttga

SEQ ID NO: 10075 - DNA, 20 bp, Artificial Sequence
  Description of Artificial Sequence: Synthetic oligonucleotide
cttccttggaatttcttgag

SEQ ID NO: 10076 - DNA, 20 bp, Artificial Sequence
  Description of Artificial Sequence: Synthetic oligonucleotide
ttccttggaatttcttgaga

SEQ ID NO: 10077 - DNA, 20 bp, Artificial Sequence
  Description of Artificial Sequence: Synthetic oligonucleotide
tccttggaatttcttgagat

SEQ ID NO: 10078 - DNA, 20 bp, Artificial Sequence
  Description of Artificial Sequence: Synthetic oligonucleotide
ccttggaatttcttgagata

SEQ ID NO: 10079 - DNA, 20 bp, Artificial Sequence
  Description of Artificial Sequence: Synthetic oligonucleotide
cttggaatttcttgagatat

SEQ ID NO: 10080 - DNA, 20 bp, Artificial Sequence
  Description of Artificial Sequence: Synthetic oligonucleotide
ttggaatttcttgagatata

SEQ ID NO: 10081 - DNA, 20 bp, Artificial Sequence
  Description of Artificial Sequence: Synthetic oligonucleotide
tggaatttcttgagatatag

SEQ ID NO: 10082 - DNA, 20 bp, Artificial Sequence
  Description of Artificial Sequence: Synthetic oligonucleotide
ggaatttcttgagatatagc

SEQ ID NO: 10083 - DNA, 20 bp, Artificial Sequence
  Description of Artificial Sequence: Synthetic oligonucleotide
gaatttcttgagatatagcc

SEQ ID NO: 10084 - DNA, 20 bp, Artificial Sequence
  Description of Artificial Sequence: Synthetic oligonucleotide
aatttcttgagatatagcct

SEQ ID NO: 10085 - DNA, 20 bp, Artificial Sequence
  Description of Artificial Sequence: Synthetic oligonucleotide
atttcttgagatatagcctg

SEQ ID NO: 10086 - DNA, 20 bp, Artificial Sequence
  Description of Artificial Sequence: Synthetic oligonucleotide
tttcttgagatatagcctgt

SEQ ID NO: 10087 - DNA, 20 bp, Artificial Sequence
  Description of Artificial Sequence: Synthetic oligonucleotide
ttcttgagatatagcctgtc

SEQ ID NO: 10088 - DNA, 20 bp, Artificial Sequence
  Description of Artificial Sequence: Synthetic oligonucleotide
tcttgagatatagcctgtca

SEQ ID NO: 10089 - DNA, 20 bp, Artificial Sequence
  Description of Artificial Sequence: Synthetic oligonucleotide
cttgagatatagcctgtcag

SEQ ID NO: 10090 - DNA, 20 bp, Artificial Sequence
  Description of Artificial Sequence: Synthetic oligonucleotide
ttgagatatagcctgtcagc

SEQ ID NO: 10091 - DNA, 20 bp, Artificial Sequence
  Description of Artificial Sequence: Synthetic oligonucleotide
tgagatatagcctgtcagct

SEQ ID NO: 10092 - DNA, 20 bp, Artificial Sequence
  Description of Artificial Sequence: Synthetic oligonucleotide
gagatatagcctgtcagctc

SEQ ID NO: 10093 - DNA, 20 bp, Artificial Sequence
  Description of Artificial Sequence: Synthetic oligonucleotide
agatatagcctgtcagctct

SEQ ID NO: 10094 - DNA, 20 bp, Artificial Sequence
  Description of Artificial Sequence: Synthetic oligonucleotide
gatatagcctgtcagctctt

SEQ ID NO: 10095 - DNA, 20 bp, Artificial Sequence
  Description of Artificial Sequence: Synthetic oligonucleotide
atatagcctgtcagctcttg

SEQ ID NO: 10096 - DNA, 20 bp, Artificial Sequence
  Description of Artificial Sequence: Synthetic oligonucleotide
tatagcctgtcagctcttgg

SEQ ID NO: 10097 - DNA, 20 bp, Artificial Sequence
  Description of Artificial Sequence: Synthetic oligonucleotide
atagcctgtcagctcttggt

SEQ ID NO: 10098 - DNA, 20 bp, Artificial Sequence
  Description of Artificial Sequence: Synthetic oligonucleotide
tagcctgtcagctcttggtg

SEQ ID NO: 10099 - DNA, 20 bp, Artificial Sequence
  Description of Artificial Sequence: Synthetic oligonucleotide
agcctgtcagctcttggtga

SEQ ID NO: 10100 - DNA, 20 bp, Artificial Sequence
  Description of Artificial Sequence: Synthetic oligonucleotide
gcctgtcagctcttggtgag

SEQ ID NO: 10101 - DNA, 20 bp, Artificial Sequence
  Description of Artificial Sequence: Synthetic oligonucleotide
cctgtcagctcttggtgagg

SEQ ID NO: 10102 - DNA, 20 bp, Artificial Sequence
  Description of Artificial Sequence: Synthetic oligonucleotide
ctgtcagctcttggtgagga

SEQ ID NO: 10103 - DNA, 20 bp, Artificial Sequence
  Description of Artificial Sequence: Synthetic oligonucleotide
tgtcagctcttggtgaggaa

SEQ ID NO: 10104 - DNA, 20 bp, Artificial Sequence
  Description of Artificial Sequence: Synthetic oligonucleotide
gtcagctcttggtgaggaag

SEQ ID NO: 10105 - DNA, 20 bp, Artificial Sequence
  Description of Artificial Sequence: Synthetic oligonucleotide
tcagctcttggtgaggaagt

SEQ ID NO: 10106 - DNA, 20 bp, Artificial Sequence
  Description of Artificial Sequence: Synthetic oligonucleotide
cagctcttggtgaggaagta

SEQ ID NO: 10107 - DNA, 20 bp, Artificial Sequence
  Description of Artificial Sequence: Synthetic oligonucleotide
agctcttggtgaggaagtag

SEQ ID NO: 10108 - DNA, 20 bp, Artificial Sequence
  Description of Artificial Sequence: Synthetic oligonucleotide
gctcttggtgaggaagtagc

SEQ ID NO: 10109 - DNA, 20 bp, Artificial Sequence
  Description of Artificial Sequence: Synthetic oligonucleotide
ctcttggtgaggaagtagca

SEQ ID NO: 10110 - DNA, 20 bp, Artificial Sequence
  Description of Artificial Sequence: Synthetic oligonucleotide
tcttggtgaggaagtagcag

SEQ ID NO: 10111 - DNA, 20 bp, Artificial Sequence
  Description of Artificial Sequence: Synthetic oligonucleotide
cttggtgaggaagtagcaga

SEQ ID NO: 10112 - DNA, 20 bp, Artificial Sequence
  Description of Artificial Sequence: Synthetic oligonucleotide
ttggtgaggaagtagcagag

SEQ ID NO: 10113 - DNA, 20 bp, Artificial Sequence
  Description of Artificial Sequence: Synthetic oligonucleotide
tggtgaggaagtagcagagc

SEQ ID NO: 10114 - DNA, 20 bp, Artificial Sequence
  Description of Artificial Sequence: Synthetic oligonucleotide
ggtgaggaagtagcagagct

SEQ ID NO: 10115 - DNA, 20 bp, Artificial Sequence
  Description of Artificial Sequence: Synthetic oligonucleotide
gtgaggaagtagcagagcta

SEQ ID NO: 10116 - DNA, 20 bp, Artificial Sequence
  Description of Artificial Sequence: Synthetic oligonucleotide
tgaggaagtagcagagctac

SEQ ID NO: 10117 - DNA, 20 bp, Artificial Sequence
  Description of Artificial Sequence: Synthetic oligonucleotide
gaggaagtagcagagctaca

SEQ ID NO: 10118 - DNA, 20 bp, Artificial Sequence
  Description of Artificial Sequence: Synthetic oligonucleotide
aggaagtagcagagctacac

SEQ ID NO: 10119 - DNA, 20 bp, Artificial Sequence
  Description of Artificial Sequence: Synthetic oligonucleotide
ggaagtagcagagctacacc

SEQ ID NO: 10120 - DNA, 20 bp, Artificial Sequence
  Description of Artificial Sequence: Synthetic oligonucleotide
gaagtagcagagctacacca

SEQ ID NO: 10121 - DNA, 20 bp, Artificial Sequence
  Description of Artificial Sequence: Synthetic oligonucleotide
aagtagcagagctacaccaa

SEQ ID NO: 10122 - DNA, 20 bp, Artificial Sequence
  Description of Artificial Sequence: Synthetic oligonucleotide
agtagcagagctacaccaat

SEQ ID NO: 10123 - DNA, 20 bp, Artificial Sequence
  Description of Artificial Sequence: Synthetic oligonucleotide
gtagcagagctacaccaatc

SEQ ID NO: 10124 - DNA, 20 bp, Artificial Sequence
  Description of Artificial Sequence: Synthetic oligonucleotide
tagcagagctacaccaatca

SEQ ID NO: 10125 - DNA, 20 bp, Artificial Sequence
  Description of Artificial Sequence: Synthetic oligonucleotide
agcagagctacaccaatcag

SEQ ID NO: 10126 - DNA, 20 bp, Artificial Sequence
  Description of Artificial Sequence: Synthetic oligonucleotide
gcagagctacaccaatcagg

SEQ ID NO: 10127 - DNA, 20 bp, Artificial Sequence
  Description of Artificial Sequence: Synthetic oligonucleotide
cagagctacaccaatcagga

SEQ ID NO: 10128 - DNA, 20 bp, Artificial Sequence
  Description of Artificial Sequence: Synthetic oligonucleotide
agagctacaccaatcaggaa

SEQ ID NO: 10129 - DNA, 20 bp, Artificial Sequence
  Description of Artificial Sequence: Synthetic oligonucleotide
gagctacaccaatcaggaag

SEQ ID NO: 10130 - DNA, 20 bp, Artificial Sequence
  Description of Artificial Sequence: Synthetic oligonucleotide
agctacaccaatcaggaaga

SEQ ID NO: 10131 - DNA, 20 bp, Artificial Sequence
  Description of Artificial Sequence: Synthetic oligonucleotide
gctacaccaatcaggaagac

SEQ ID NO: 10132 - DNA, 20 bp, Artificial Sequence
  Description of Artificial Sequence: Synthetic oligonucleotide
ctacaccaatcaggaagact

SEQ ID NO: 10133 - DNA, 20 bp, Artificial Sequence
  Description of Artificial Sequence: Synthetic oligonucleotide
tacaccaatcaggaagactt

SEQ ID NO: 10134 - DNA, 20 bp, Artificial Sequence
  Description of Artificial Sequence: Synthetic oligonucleotide
acaccaatcaggaagacttg

SEQ ID NO: 10135 - DNA, 20 bp, Artificial Sequence
  Description of Artificial Sequence: Synthetic oligonucleotide
caccaatcaggaagacttga

SEQ ID NO: 10136 - DNA, 20 bp, Artificial Sequence
  Description of Artificial Sequence: Synthetic oligonucleotide
accaatcaggaagacttgaa

SEQ ID NO: 10137 - DNA, 20 bp, Artificial Sequence
  Description of Artificial Sequence: Synthetic oligonucleotide
ccaatcaggaagacttgaac

SEQ ID NO: 10138 - DNA, 20 bp, Artificial Sequence
  Description of Artificial Sequence: Synthetic oligonucleotide
caatcaggaagacttgaacc

SEQ ID NO: 10139 - DNA, 20 bp, Artificial Sequence
  Description of Artificial Sequence: Synthetic oligonucleotide
aatcaggaagacttgaaccc

SEQ ID NO: 10140 - DNA, 20 bp, Artificial Sequence
  Description of Artificial Sequence: Synthetic oligonucleotide
atcaggaagacttgaaccct

SEQ ID NO: 10141 - DNA, 20 bp, Artificial Sequence
  Description of Artificial Sequence: Synthetic oligonucleotide
tcaggaagacttgaaccctg

SEQ ID NO: 10142 - DNA, 20 bp, Artificial Sequence
  Description of Artificial Sequence: Synthetic oligonucleotide
caggaagacttgaaccctgc

SEQ ID NO: 10143 - DNA, 20 bp, Artificial Sequence
  Description of Artificial Sequence: Synthetic oligonucleotide
aggaagacttgaaccctgct

SEQ ID NO: 10144 - DNA, 20 bp, Artificial Sequence
  Description of Artificial Sequence: Synthetic oligonucleotide
ggaagacttgaaccctgctt

SEQ ID NO: 10145 - DNA, 20 bp, Artificial Sequence
  Description of Artificial Sequence: Synthetic oligonucleotide
gaagacttgaaccctgcttc

SEQ ID NO: 10146 - DNA, 20 bp, Artificial Sequence
  Description of Artificial Sequence: Synthetic oligonucleotide
aagacttgaaccctgcttct

SEQ ID NO: 10147 - DNA, 20 bp, Artificial Sequence
  Description of Artificial Sequence: Synthetic oligonucleotide
agacttgaaccctgcttcta

SEQ ID NO: 10148 - DNA, 20 bp, Artificial Sequence
  Description of Artificial Sequence: Synthetic oligonucleotide
gacttgaaccctgcttctaa

SEQ ID NO: 10149 - DNA, 20 bp, Artificial Sequence
  Description of Artificial Sequence: Synthetic oligonucleotide
acttgaaccctgcttctaag

SEQ ID NO: 10150 - DNA, 20 bp, Artificial Sequence
  Description of Artificial Sequence: Synthetic oligonucleotide
cttgaaccctgcttctaaga

SEQ ID NO: 10151 - DNA, 20 bp, Artificial Sequence
  Description of Artificial Sequence: Synthetic oligonucleotide
ttgaaccctgcttctaagac

SEQ ID NO: 10152 - DNA, 20 bp, Artificial Sequence
  Description of Artificial Sequence: Synthetic oligonucleotide
tgaaccctgcttctaagact

SEQ ID NO: 10153 - DNA, 20 bp, Artificial Sequence
  Description of Artificial Sequence: Synthetic oligonucleotide
gaaccctgcttctaagactt

SEQ ID NO: 10154 - DNA, 20 bp, Artificial Sequence
  Description of Artificial Sequence: Synthetic oligonucleotide
aaccctgcttctaagacttg

SEQ ID NO: 10155 - DNA, 20 bp, Artificial Sequence
  Description of Artificial Sequence: Synthetic oligonucleotide
accctgcttctaagacttgc

SEQ ID NO: 10156 - DNA, 20 bp, Artificial Sequence
  Description of Artificial Sequence: Synthetic oligonucleotide
ccctgcttctaagacttgct

SEQ ID NO: 10157 - DNA, 20 bp, Artificial Sequence
  Description of Artificial Sequence: Synthetic oligonucleotide
cctgcttctaagacttgctg

SEQ ID NO: 10158 - DNA, 20 bp, Artificial Sequence
  Description of Artificial Sequence: Synthetic oligonucleotide
ctgcttctaagacttgctgg

SEQ ID NO: 10159 - DNA, 20 bp, Artificial Sequence
  Description of Artificial Sequence: Synthetic oligonucleotide
tgcttctaagacttgctggg

SEQ ID NO: 10160 - DNA, 20 bp, Artificial Sequence
  Description of Artificial Sequence: Synthetic oligonucleotide
gcttctaagacttgctgggt

SEQ ID NO: 10161 - DNA, 20 bp, Artificial Sequence
  Description of Artificial Sequence: Synthetic oligonucleotide
cttctaagacttgctgggtg

SEQ ID NO: 10162 - DNA, 20 bp, Artificial Sequence
  Description of Artificial Sequence: Synthetic oligonucleotide
ttctaagacttgctgggtga

SEQ ID NO: 10163 - DNA, 20 bp, Artificial Sequence
  Description of Artificial Sequence: Synthetic oligonucleotide
tctaagacttgctgggtgac

SEQ ID NO: 10164 - DNA, 20 bp, Artificial Sequence
  Description of Artificial Sequence: Synthetic oligonucleotide
ctaagacttgctgggtgact

SEQ ID NO: 10165 - DNA, 20 bp, Artificial Sequence
  Description of Artificial Sequence: Synthetic oligonucleotide
taagacttgctgggtgactt

SEQ ID NO: 10166 - DNA, 20 bp, Artificial Sequence
  Description of Artificial Sequence: Synthetic oligonucleotide
aagacttgctgggtgacttt

SEQ ID NO: 10167 - DNA, 20 bp, Artificial Sequence
  Description of Artificial Sequence: Synthetic oligonucleotide
agacttgctgggtgactttg

SEQ ID NO: 10168 - DNA, 20 bp, Artificial Sequence
  Description of Artificial Sequence: Synthetic oligonucleotide
gacttgctgggtgactttgg

SEQ ID NO: 10169 - DNA, 20 bp, Artificial Sequence
  Description of Artificial Sequence: Synthetic oligonucleotide
acttgctgggtgactttggg

SEQ ID NO: 10170 - DNA, 20 bp, Artificial Sequence
  Description of Artificial Sequence: Synthetic oligonucleotide
cttgctgggtgactttgggc

SEQ ID NO: 10171 - DNA, 20 bp, Artificial Sequence
  Description of Artificial Sequence: Synthetic oligonucleotide
ttgctgggtgactttgggca

SEQ ID NO: 10172 - DNA, 20 bp, Artificial Sequence
  Description of Artificial Sequence: Synthetic oligonucleotide
tgctgggtgactttgggcaa

SEQ ID NO: 10173 - DNA, 20 bp, Artificial Sequence
  Description of Artificial Sequence: Synthetic oligonucleotide
gctgggtgactttgggcaaa

SEQ ID NO: 10174 - DNA, 20 bp, Artificial Sequence
  Description of Artificial Sequence: Synthetic oligonucleotide
ctgggtgactttgggcaaac

SEQ ID NO: 10175 - DNA, 20 bp, Artificial Sequence
  Description of Artificial Sequence: Synthetic oligonucleotide
tgggtgactttgggcaaacc

SEQ ID NO: 10176 - DNA, 20 bp, Artificial Sequence
  Description of Artificial Sequence: Synthetic oligonucleotide
gggtgactttgggcaaacca

SEQ ID NO: 10177 - DNA, 20 bp, Artificial Sequence
  Description of Artificial Sequence: Synthetic oligonucleotide
ggtgactttgggcaaaccat

SEQ ID NO: 10178 - DNA, 20 bp, Artificial Sequence
  Description of Artificial Sequence: Synthetic oligonucleotide
gtgactttgggcaaaccatg

SEQ ID NO: 10179 - DNA, 20 bp, Artificial Sequence
  Description of Artificial Sequence: Synthetic oligonucleotide
tgactttgggcaaaccatgt

SEQ ID NO: 10180 - DNA, 20 bp, Artificial Sequence
  Description of Artificial Sequence: Synthetic oligonucleotide
gactttgggcaaaccatgta

SEQ ID NO: 10181 - DNA, 20 bp, Artificial Sequence
  Description of Artificial Sequence: Synthetic oligonucleotide
actttgggcaaaccatgtag

SEQ ID NO: 10182 - DNA, 20 bp, Artificial Sequence
  Description of Artificial Sequence: Synthetic oligonucleotide
ctttgggcaaaccatgtagt

SEQ ID NO: 10183 - DNA, 20 bp, Artificial Sequence
  Description of Artificial Sequence: Synthetic oligonucleotide
tttgggcaaaccatgtagta

SEQ ID NO: 10184 - DNA, 20 bp, Artificial Sequence
  Description of Artificial Sequence: Synthetic oligonucleotide
ttgggcaaaccatgtagtat

SEQ ID NO: 10185 - DNA, 20 bp, Artificial Sequence
  Description of Artificial Sequence: Synthetic oligonucleotide
tgggcaaaccatgtagtatc

SEQ ID NO: 10186 - DNA, 20 bp, Artificial Sequence
  Description of Artificial Sequence: Synthetic oligonucleotide
gggcaaaccatgtagtatct

SEQ ID NO: 10187 - DNA, 20 bp, Artificial Sequence
  Description of Artificial Sequence: Synthetic oligonucleotide
ggcaaaccatgtagtatctc

SEQ ID NO: 10188 - DNA, 20 bp, Artificial Sequence
  Description of Artificial Sequence: Synthetic oligonucleotide
gcaaaccatgtagtatctca

SEQ ID NO: 10189 - DNA, 20 bp, Artificial Sequence
  Description of Artificial Sequence: Synthetic oligonucleotide
caaaccatgtagtatctcag

SEQ ID NO: 10190 - DNA, 20 bp, Artificial Sequence
  Description of Artificial Sequence: Synthetic oligonucleotide
aaaccatgtagtatctcagc

SEQ ID NO: 10191 - DNA, 20 bp, Artificial Sequence
  Description of Artificial Sequence: Synthetic oligonucleotide
aaccatgtagtatctcagca

SEQ ID NO: 10192 - DNA, 20 bp, Artificial Sequence
  Description of Artificial Sequence: Synthetic oligonucleotide
accatgtagtatctcagcac

SEQ ID NO: 10193 - DNA, 20 bp, Artificial Sequence
  Description of Artificial Sequence: Synthetic oligonucleotide
ccatgtagtatctcagcact

SEQ ID NO: 10194 - DNA, 20 bp, Artificial Sequence
  Description of Artificial Sequence: Synthetic oligonucleotide
catgtagtatctcagcactc

SEQ ID NO: 10195 - DNA, 20 bp, Artificial Sequence
  Description of Artificial Sequence: Synthetic oligonucleotide
atgtagtatctcagcactcc

SEQ ID NO: 10196 - DNA, 20 bp, Artificial Sequence
  Description of Artificial Sequence: Synthetic oligonucleotide
tgtagtatctcagcactcca

SEQ ID NO: 10197 - DNA, 20 bp, Artificial Sequence
  Description of Artificial Sequence: Synthetic oligonucleotide
gtagtatctcagcactccaa

SEQ ID NO: 10198 - DNA, 20 bp, Artificial Sequence
  Description of Artificial Sequence: Synthetic oligonucleotide
tagtatctcagcactccaag

SEQ ID NO: 10199 - DNA, 20 bp, Artificial Sequence
  Description of Artificial Sequence: Synthetic oligonucleotide
agtatctcagcactccaaga

SEQ ID NO: 10200 - DNA, 20 bp, Artificial Sequence
  Description of Artificial Sequence: Synthetic oligonucleotide
gtatctcagcactccaagat

SEQ ID NO: 10201 - DNA, 20 bp, Artificial Sequence
  Description of Artificial Sequence: Synthetic oligonucleotide
tatctcagcactccaagatg

SEQ ID NO: 10202 - DNA, 20 bp, Artificial Sequence
  Description of Artificial Sequence: Synthetic oligonucleotide
atctcagcactccaagatgg

SEQ ID NO: 10203 - DNA, 20 bp, Artificial Sequence
  Description of Artificial Sequence: Synthetic oligonucleotide
tctcagcactccaagatggt

SEQ ID NO: 10204 - DNA, 20 bp, Artificial Sequence
  Description of Artificial Sequence: Synthetic oligonucleotide
ctcagcactccaagatggta

SEQ ID NO: 10205 - DNA, 20 bp, Artificial Sequence
  Description of Artificial Sequence: Synthetic oligonucleotide
tcagcactccaagatggtag

SEQ ID NO: 10206 - DNA, 20 bp, Artificial Sequence
  Description of Artificial Sequence: Synthetic oligonucleotide
cagcactccaagatggtagg

SEQ ID NO: 10207 - DNA, 20 bp, Artificial Sequence
  Description of Artificial Sequence: Synthetic oligonucleotide
agcactccaagatggtaggc

SEQ ID NO: 10208 - DNA, 20 bp, Artificial Sequence
  Description of Artificial Sequence: Synthetic oligonucleotide
gcactccaagatggtaggct

SEQ ID NO: 10209 - DNA, 20 bp, Artificial Sequence
  Description of Artificial Sequence: Synthetic oligonucleotide
cactccaagatggtaggctg

SEQ ID NO: 10210 - DNA, 20 bp, Artificial Sequence
  Description of Artificial Sequence: Synthetic oligonucleotide
actccaagatggtaggctga

SEQ ID NO: 10211 - DNA, 20 bp, Artificial Sequence
  Description of Artificial Sequence: Synthetic oligonucleotide
ctccaagatggtaggctgaa

SEQ ID NO: 10212 - DNA, 20 bp, Artificial Sequence
  Description of Artificial Sequence: Synthetic oligonucleotide
tccaagatggtaggctgaaa

SEQ ID NO: 10213 - DNA, 20 bp, Artificial Sequence
  Description of Artificial Sequence: Synthetic oligonucleotide
ccaagatggtaggctgaaac

SEQ ID NO: 10214 - DNA, 20 bp, Artificial Sequence
  Description of Artificial Sequence: Synthetic oligonucleotide
caagatggtaggctgaaaca

SEQ ID NO: 10215 - DNA, 20 bp, Artificial Sequence
  Description of Artificial Sequence: Synthetic oligonucleotide
aagatggtaggctgaaacac

SEQ ID NO: 10216 - DNA, 20 bp, Artificial Sequence
  Description of Artificial Sequence: Synthetic oligonucleotide
agatggtaggctgaaacact

SEQ ID NO: 10217 - DNA, 20 bp, Artificial Sequence
  Description of Artificial Sequence: Synthetic oligonucleotide
gatggtaggctgaaacactg

SEQ ID NO: 10218 - DNA, 20 bp, Artificial Sequence
  Description of Artificial Sequence: Synthetic oligonucleotide
atggtaggctgaaacactgt

SEQ ID NO: 10219 - DNA, 20 bp, Artificial Sequence
  Description of Artificial Sequence: Synthetic oligonucleotide
tggtaggctgaaacactgtg

SEQ ID NO: 10220 - DNA, 20 bp, Artificial Sequence
  Description of Artificial Sequence: Synthetic oligonucleotide
ggtaggctgaaacactgtgt

SEQ ID NO: 10221 - DNA, 20 bp, Artificial Sequence
  Description of Artificial Sequence: Synthetic oligonucleotide
gtaggctgaaacactgtgtg

SEQ ID NO: 10222 - DNA, 20 bp, Artificial Sequence
  Description of Artificial Sequence: Synthetic oligonucleotide
taggctgaaacactgtgtgg

SEQ ID NO: 10223 - DNA, 20 bp, Artificial Sequence
  Description of Artificial Sequence: Synthetic oligonucleotide
aggctgaaacactgtgtgga

SEQ ID NO: 10224 - DNA, 20 bp, Artificial Sequence
  Description of Artificial Sequence: Synthetic oligonucleotide
ggctgaaacactgtgtggat

SEQ ID NO: 10225 - DNA, 20 bp, Artificial Sequence
  Description of Artificial Sequence: Synthetic oligonucleotide
gctgaaacactgtgtggata

SEQ ID NO: 10226 - DNA, 20 bp, Artificial Sequence
  Description of Artificial Sequence: Synthetic oligonucleotide
ctgaaacactgtgtggataa

SEQ ID NO: 10227 - DNA, 20 bp, Artificial Sequence
  Description of Artificial Sequence: Synthetic oligonucleotide
tgaaacactgtgtggataaa

SEQ ID NO: 10228 - DNA, 20 bp, Artificial Sequence
  Description of Artificial Sequence: Synthetic oligonucleotide
gaaacactgtgtggataaaa

SEQ ID NO: 10229 - DNA, 20 bp, Artificial Sequence
  Description of Artificial Sequence: Synthetic oligonucleotide
aaacactgtgtggataaaag

SEQ ID NO: 10230 - DNA, 20 bp, Artificial Sequence
  Description of Artificial Sequence: Synthetic oligonucleotide
aacactgtgtggataaaaga

SEQ ID NO: 10231 - DNA, 20 bp, Artificial Sequence
  Description of Artificial Sequence: Synthetic oligonucleotide
acactgtgtggataaaagag

SEQ ID NO: 10232 - DNA, 20 bp, Artificial Sequence
  Description of Artificial Sequence: Synthetic oligonucleotide
cactgtgtggataaaagaga

SEQ ID NO: 10233 - DNA, 20 bp, Artificial Sequence
  Description of Artificial Sequence: Synthetic oligonucleotide
actgtgtggataaaagagac

SEQ ID NO: 10234 - DNA, 20 bp, Artificial Sequence
  Description of Artificial Sequence: Synthetic oligonucleotide
ctgtgtggataaaagagacc

SEQ ID NO: 10235 - DNA, 20 bp, Artificial Sequence
  Description of Artificial Sequence: Synthetic oligonucleotide
tgtgtggataaaagagaccc

SEQ ID NO: 10236 - DNA, 20 bp, Artificial Sequence
  Description of Artificial Sequence: Synthetic oligonucleotide
gtgtggataaaagagacccg

SEQ ID NO: 10237 - DNA, 20 bp, Artificial Sequence
  Description of Artificial Sequence: Synthetic oligonucleotide
tgtggataaaagagacccgt

SEQ ID NO: 10238 - DNA, 20 bp, Artificial Sequence
  Description of Artificial Sequence: Synthetic oligonucleotide
gtggataaaagagacccgtg

SEQ ID NO: 10239 - DNA, 20 bp, Artificial Sequence
  Description of Artificial Sequence: Synthetic oligonucleotide
tggataaaagagacccgtga

SEQ ID NO: 10240 - DNA, 20 bp, Artificial Sequence
  Description of Artificial Sequence: Synthetic oligonucleotide
ggataaaagagacccgtgaa

SEQ ID NO: 10241 - DNA, 20 bp, Artificial Sequence
  Description of Artificial Sequence: Synthetic oligonucleotide
gataaaagagacccgtgaag

SEQ ID NO: 10242 - DNA, 20 bp, Artificial Sequence
  Description of Artificial Sequence: Synthetic oligonucleotide
ataaaagagacccgtgaagg

SEQ ID NO: 10243 - DNA, 20 bp, Artificial Sequence
  Description of Artificial Sequence: Synthetic oligonucleotide
taaaagagacccgtgaaggt

SEQ ID NO: 10244 - DNA, 20 bp, Artificial Sequence
  Description of Artificial Sequence: Synthetic oligonucleotide
aaaagagacccgtgaaggtg

SEQ ID NO: 10245 - DNA, 20 bp, Artificial Sequence
  Description of Artificial Sequence: Synthetic oligonucleotide
aaagagacccgtgaaggtgt

SEQ ID NO: 10246 - DNA, 20 bp, Artificial Sequence
  Description of Artificial Sequence: Synthetic oligonucleotide
aagagacccgtgaaggtgtt

SEQ ID NO: 10247 - DNA, 20 bp, Artificial Sequence
  Description of Artificial Sequence: Synthetic oligonucleotide
agagacccgtgaaggtgtta

SEQ ID NO: 10248 - DNA, 20 bp, Artificial Sequence
  Description of Artificial Sequence: Synthetic oligonucleotide
gagacccgtgaaggtgttag

SEQ ID NO: 10249 - DNA, 20 bp, Artificial Sequence
  Description of Artificial Sequence: Synthetic oligonucleotide
agacccgtgaaggtgttagg

SEQ ID NO: 10250 - DNA, 20 bp, Artificial Sequence
  Description of Artificial Sequence: Synthetic oligonucleotide
gacccgtgaaggtgttaggt

SEQ ID NO: 10251 - DNA, 20 bp, Artificial Sequence
  Description of Artificial Sequence: Synthetic oligonucleotide
acccgtgaaggtgttaggta

SEQ ID NO: 10252 - DNA, 20 bp, Artificial Sequence
  Description of Artificial Sequence: Synthetic oligonucleotide
cccgtgaaggtgttaggtaa

SEQ ID NO: 10253 - DNA, 20 bp, Artificial Sequence
  Description of Artificial Sequence: Synthetic oligonucleotide
ccgtgaaggtgttaggtaaa

SEQ ID NO: 10254 - DNA, 20 bp, Artificial Sequence
  Description of Artificial Sequence: Synthetic oligonucleotide
cgtgaaggtgttaggtaaac

SEQ ID NO: 10255 - DNA, 20 bp, Artificial Sequence
  Description of Artificial Sequence: Synthetic oligonucleotide
gtgaaggtgttaggtaaact

SEQ ID NO: 10256 - DNA, 20 bp, Artificial Sequence
  Description of Artificial Sequence: Synthetic oligonucleotide
tgaaggtgttaggtaaactt

SEQ ID NO: 10257 - DNA, 20 bp, Artificial Sequence
  Description of Artificial Sequence: Synthetic oligonucleotide
gaaggtgttaggtaaactta

SEQ ID NO: 10258 - DNA, 20 bp, Artificial Sequence
  Description of Artificial Sequence: Synthetic oligonucleotide
aaggtgttaggtaaacttac

SEQ ID NO: 10259 - DNA, 20 bp, Artificial Sequence
  Description of Artificial Sequence: Synthetic oligonucleotide
aggtgttaggtaaacttaca

SEQ ID NO: 10260 - DNA, 20 bp, Artificial Sequence
  Description of Artificial Sequence: Synthetic oligonucleotide
ggtgttaggtaaacttacat

SEQ ID NO: 10261 - DNA, 20 bp, Artificial Sequence
  Description of Artificial Sequence: Synthetic oligonucleotide
gtgttaggtaaacttacata

SEQ ID NO: 10262 - DNA, 20 bp, Artificial Sequence
  Description of Artificial Sequence: Synthetic oligonucleotide
tgttaggtaaacttacatag

SEQ ID NO: 10263 - DNA, 20 bp, Artificial Sequence
  Description of Artificial Sequence: Synthetic oligonucleotide
gttaggtaaacttacatagc

SEQ ID NO: 10264 - DNA, 20 bp, Artificial Sequence
  Description of Artificial Sequence: Synthetic oligonucleotide
ttaggtaaacttacatagca

SEQ ID NO: 10265 - DNA, 20 bp, Artificial Sequence
  Description of Artificial Sequence: Synthetic oligonucleotide
taggtaaacttacatagcat

SEQ ID NO: 10266 - DNA, 20 bp, Artificial Sequence
  Description of Artificial Sequence: Synthetic oligonucleotide
aggtaaacttacatagcatt

SEQ ID NO: 10267 - DNA, 20 bp, Artificial Sequence
  Description of Artificial Sequence: Synthetic oligonucleotide
ggtaaacttacatagcatta

SEQ ID NO: 10268 - DNA, 20 bp, Artificial Sequence
  Description of Artificial Sequence: Synthetic oligonucleotide
gtaaacttacatagcattag

SEQ ID NO: 10269 - DNA, 20 bp, Artificial Sequence
  Description of Artificial Sequence: Synthetic oligonucleotide
taaacttacatagcattaga

SEQ ID NO: 10270 - DNA, 20 bp, Artificial Sequence
  Description of Artificial Sequence: Synthetic oligonucleotide
aaacttacatagcattagaa

SEQ ID NO: 10271 - DNA, 20 bp, Artificial Sequence
  Description of Artificial Sequence: Synthetic oligonucleotide
aacttacatagcattagaag

SEQ ID NO: 10272 - DNA, 20 bp, Artificial Sequence
  Description of Artificial Sequence: Synthetic oligonucleotide
acttacatagcattagaagt

SEQ ID NO: 10273 - DNA, 20 bp, Artificial Sequence
  Description of Artificial Sequence: Synthetic oligonucleotide
cttacatagcattagaagtc

SEQ ID NO: 10274 - DNA, 20 bp, Artificial Sequence
  Description of Artificial Sequence: Synthetic oligonucleotide
ttacatagcattagaagtca

SEQ ID NO: 10275 - DNA, 20 bp, Artificial Sequence
  Description of Artificial Sequence: Synthetic oligonucleotide
tacatagcattagaagtcaa

SEQ ID NO: 10276 - DNA, 20 bp, Artificial Sequence
  Description of Artificial Sequence: Synthetic oligonucleotide
acatagcattagaagtcaaa

SEQ ID NO: 10277 - DNA, 20 bp, Artificial Sequence
  Description of Artificial Sequence: Synthetic oligonucleotide
catagcattagaagtcaaag

SEQ ID NO: 10278 - DNA, 20 bp, Artificial Sequence
  Description of Artificial Sequence: Synthetic oligonucleotide
atagcattagaagtcaaagg

SEQ ID NO: 10279 - DNA, 20 bp, Artificial Sequence
  Description of Artificial Sequence: Synthetic oligonucleotide
tagcattagaagtcaaagga

SEQ ID NO: 10280 - DNA, 20 bp, Artificial Sequence
  Description of Artificial Sequence: Synthetic oligonucleotide
agcattagaagtcaaaggaa

SEQ ID NO: 10281 - DNA, 20 bp, Artificial Sequence
  Description of Artificial Sequence: Synthetic oligonucleotide
gcattagaagtcaaaggaaa

SEQ ID NO: 10282 - DNA, 20 bp, Artificial Sequence
  Description of Artificial Sequence: Synthetic oligonucleotide
cattagaagtcaaaggaaat

SEQ ID NO: 10283 - DNA, 20 bp, Artificial Sequence
  Description of Artificial Sequence: Synthetic oligonucleotide
attagaagtcaaaggaaata

SEQ ID NO: 10284 - DNA, 20 bp, Artificial Sequence
  Description of Artificial Sequence: Synthetic oligonucleotide
ttagaagtcaaaggaaatac

SEQ ID NO: 10285 - DNA, 20 bp, Artificial Sequence
  Description of Artificial Sequence: Synthetic oligonucleotide
tagaagtcaaaggaaatact

SEQ ID NO: 10286 - DNA, 20 bp, Artificial Sequence
  Description of Artificial Sequence: Synthetic oligonucleotide
agaagtcaaaggaaatactg

SEQ ID NO: 10287 - DNA, 20 bp, Artificial Sequence
  Description of Artificial Sequence: Synthetic oligonucleotide
gaagtcaaaggaaatactgc

SEQ ID NO: 10288 - DNA, 20 bp, Artificial Sequence
  Description of Artificial Sequence: Synthetic oligonucleotide
aagtcaaaggaaatactgca

SEQ ID NO: 10289 - DNA, 20 bp, Artificial Sequence
  Description of Artificial Sequence: Synthetic oligonucleotide
agtcaaaggaaatactgcat

SEQ ID NO: 10290 - DNA, 20 bp, Artificial Sequence
  Description of Artificial Sequence: Synthetic oligonucleotide
gtcaaaggaaatactgcata

SEQ ID NO: 10291 - DNA, 20 bp, Artificial Sequence
  Description of Artificial Sequence: Synthetic oligonucleotide
tcaaaggaaatactgcataa

SEQ ID NO: 10292 - DNA, 20 bp, Artificial Sequence
  Description of Artificial Sequence: Synthetic oligonucleotide
caaaggaaatactgcataag

SEQ ID NO: 10293 - DNA, 20 bp, Artificial Sequence
  Description of Artificial Sequence: Synthetic oligonucleotide
aaaggaaatactgcataagc

SEQ ID NO: 10294 - DNA, 20 bp, Artificial Sequence
  Description of Artificial Sequence: Synthetic oligonucleotide
aaggaaatactgcataagcc

SEQ ID NO: 10295 - DNA, 20 bp, Artificial Sequence
  Description of Artificial Sequence: Synthetic oligonucleotide
aggaaatactgcataagcct

SEQ ID NO: 10296 - DNA, 20 bp, Artificial Sequence
  Description of Artificial Sequence: Synthetic oligonucleotide
ggaaatactgcataagcctt

SEQ ID NO: 10297 - DNA, 20 bp, Artificial Sequence
  Description of Artificial Sequence: Synthetic oligonucleotide
gaaatactgcataagccttt

SEQ ID NO: 10298 - DNA, 20 bp, Artificial Sequence
  Description of Artificial Sequence: Synthetic oligonucleotide
aaatactgcataagccttta

SEQ ID NO: 10299 - DNA, 20 bp, Artificial Sequence
  Description of Artificial Sequence: Synthetic oligonucleotide
aatactgcataagcctttac

SEQ ID NO: 10300 - DNA, 20 bp, Artificial Sequence
  Description of Artificial Sequence: Synthetic oligonucleotide
atactgcataagcctttact

SEQ ID NO: 10301 - DNA, 20 bp, Artificial Sequence
  Description of Artificial Sequence: Synthetic oligonucleotide
tactgcataagcctttacta

SEQ ID NO: 10302 - DNA, 20 bp, Artificial Sequence
  Description of Artificial Sequence: Synthetic oligonucleotide
actgcataagcctttactaa

SEQ ID NO: 10303 - DNA, 20 bp, Artificial Sequence
  Description of Artificial Sequence: Synthetic oligonucleotide
ctgcataagcctttactaaa

SEQ ID NO: 10304 - DNA, 20 bp, Artificial Sequence
  Description of Artificial Sequence: Synthetic oligonucleotide
tgcataagcctttactaaag

SEQ ID NO: 10305 - DNA, 20 bp, Artificial Sequence
  Description of Artificial Sequence: Synthetic oligonucleotide
gcataagcctttactaaagg

SEQ ID NO: 10306 - DNA, 20 bp, Artificial Sequence
  Description of Artificial Sequence: Synthetic oligonucleotide
cataagcctttactaaaggg

SEQ ID NO: 10307 - DNA, 20 bp, Artificial Sequence
  Description of Artificial Sequence: Synthetic oligonucleotide
ataagcctttactaaaggga

SEQ ID NO: 10308 - DNA, 20 bp, Artificial Sequence
  Description of Artificial Sequence: Synthetic oligonucleotide
taagcctttactaaagggaa

SEQ ID NO: 10309 - DNA, 20 bp, Artificial Sequence
  Description of Artificial Sequence: Synthetic oligonucleotide
aagcctttactaaagggaaa

SEQ ID NO: 10310 - DNA, 20 bp, Artificial Sequence
  Description of Artificial Sequence: Synthetic oligonucleotide
agcctttactaaagggaaag

SEQ ID NO: 10311 - DNA, 20 bp, Artificial Sequence
  Description of Artificial Sequence: Synthetic oligonucleotide
gcctttactaaagggaaagt

SEQ ID NO: 10312 - DNA, 20 bp, Artificial Sequence
  Description of Artificial Sequence: Synthetic oligonucleotide
cctttactaaagggaaagtg

SEQ ID NO: 10313 - DNA, 20 bp, Artificial Sequence
  Description of Artificial Sequence: Synthetic oligonucleotide
ctttactaaagggaaagtgt

SEQ ID NO: 10314 - DNA, 20 bp, Artificial Sequence
  Description of Artificial Sequence: Synthetic oligonucleotide
tttactaaagggaaagtgta

SEQ ID NO: 10315 - DNA, 20 bp, Artificial Sequence
  Description of Artificial Sequence: Synthetic oligonucleotide
ttactaaagggaaagtgtac

SEQ ID NO: 10316 - DNA, 20 bp, Artificial Sequence
  Description of Artificial Sequence: Synthetic oligonucleotide
tactaaagggaaagtgtacc

SEQ ID NO: 10317 - DNA, 20 bp, Artificial Sequence
  Description of Artificial Sequence: Synthetic oligonucleotide
actaaagggaaagtgtaccc

SEQ ID NO: 10318 - DNA, 20 bp, Artificial Sequence
  Description of Artificial Sequence: Synthetic oligonucleotide
ctaaagggaaagtgtaccca

SEQ ID NO: 10319 - DNA, 20 bp, Artificial Sequence
  Description of Artificial Sequence: Synthetic oligonucleotide
taaagggaaagtgtacccac

SEQ ID NO: 10320 - DNA, 20 bp, Artificial Sequence
  Description of Artificial Sequence: Synthetic oligonucleotide
aaagggaaagtgtacccaca

SEQ ID NO: 10321 - DNA, 20 bp, Artificial Sequence
  Description of Artificial Sequence: Synthetic oligonucleotide
aagggaaagtgtacccacaa

SEQ ID NO: 10322 - DNA, 20 bp, Artificial Sequence
  Description of Artificial Sequence: Synthetic oligonucleotide
agggaaagtgtacccacaaa

SEQ ID NO: 10323 - DNA, 20 bp, Artificial Sequence
  Description of Artificial Sequence: Synthetic oligonucleotide
gggaaagtgtacccacaaaa

SEQ ID NO: 10324 - DNA, 20 bp, Artificial Sequence
  Description of Artificial Sequence: Synthetic oligonucleotide
ggaaagtgtacccacaaaag

SEQ ID NO: 10325 - DNA, 20 bp, Artificial Sequence
  Description of Artificial Sequence: Synthetic oligonucleotide
gaaagtgtacccacaaaaga

SEQ ID NO: 10326 - DNA, 20 bp, Artificial Sequence
  Description of Artificial Sequence: Synthetic oligonucleotide
aaagtgtacccacaaaagag

SEQ ID NO: 10327 - DNA, 20 bp, Artificial Sequence
  Description of Artificial Sequence: Synthetic oligonucleotide
aagtgtacccacaaaagagg

SEQ ID NO: 10328 - DNA, 20 bp, Artificial Sequence
  Description of Artificial Sequence: Synthetic oligonucleotide
agtgtacccacaaaagaggc

SEQ ID NO: 10329 - DNA, 20 bp, Artificial Sequence
  Description of Artificial Sequence: Synthetic oligonucleotide
gtgtacccacaaaagaggcc

SEQ ID NO: 10330 - DNA, 20 bp, Artificial Sequence
  Description of Artificial Sequence: Synthetic oligonucleotide
tgtacccacaaaagaggccc

SEQ ID NO: 10331 - DNA, 20 bp, Artificial Sequence
  Description of Artificial Sequence: Synthetic oligonucleotide
gtacccacaaaagaggcccc

SEQ ID NO: 10332 - DNA, 20 bp, Artificial Sequence
  Description of Artificial Sequence: Synthetic oligonucleotide
tacccacaaaagaggcccca

SEQ ID NO: 10333 - DNA, 20 bp, Artificial Sequence
  Description of Artificial Sequence: Synthetic oligonucleotide
acccacaaaagaggccccag

SEQ ID NO: 10334 - DNA, 20 bp, Artificial Sequence
  Description of Artificial Sequence: Synthetic oligonucleotide
cccacaaaagaggccccagt

SEQ ID NO: 10335 - DNA, 20 bp, Artificial Sequence
  Description of Artificial Sequence: Synthetic oligonucleotide
ccacaaaagaggccccagta

SEQ ID NO: 10336 - DNA, 20 bp, Artificial Sequence
  Description of Artificial Sequence: Synthetic oligonucleotide
cacaaaagaggccccagtag

SEQ ID NO: 10337 - DNA, 20 bp, Artificial Sequence
  Description of Artificial Sequence: Synthetic oligonucleotide
acaaaagaggccccagtagt

SEQ ID NO: 10338 - DNA, 20 bp, Artificial Sequence
  Description of Artificial Sequence: Synthetic oligonucleotide
caaaagaggccccagtagtg

SEQ ID NO: 10339 - DNA, 20 bp, Artificial Sequence
  Description of Artificial Sequence: Synthetic oligonucleotide
aaaagaggccccagtagtgg

SEQ ID NO: 10340 - DNA, 20 bp, Artificial Sequence
  Description of Artificial Sequence: Synthetic oligonucleotide
aaagaggccccagtagtggt

SEQ ID NO: 10341 - DNA, 20 bp, Artificial Sequence
  Description of Artificial Sequence: Synthetic oligonucleotide
aagaggccccagtagtggtt

SEQ ID NO: 10342 - DNA, 20 bp, Artificial Sequence
  Description of Artificial Sequence: Synthetic oligonucleotide
agaggccccagtagtggttc

SEQ ID NO: 10343 - DNA, 20 bp, Artificial Sequence
  Description of Artificial Sequence: Synthetic oligonucleotide
gaggccccagtagtggttct

SEQ ID NO: 10344 - DNA, 20 bp, Artificial Sequence
  Description of Artificial Sequence: Synthetic oligonucleotide
aggccccagtagtggttctg

SEQ ID NO: 10345 - DNA, 20 bp, Artificial Sequence
  Description of Artificial Sequence: Synthetic oligonucleotide
ggccccagtagtggttctga

SEQ ID NO: 10346 - DNA, 20 bp, Artificial Sequence
  Description of Artificial Sequence: Synthetic oligonucleotide
gccccagtagtggttctgat

SEQ ID NO: 10347 - DNA, 20 bp, Artificial Sequence
  Description of Artificial Sequence: Synthetic oligonucleotide
ccccagtagtggttctgatg

SEQ ID NO: 10348 - DNA, 20 bp, Artificial Sequence
  Description of Artificial Sequence: Synthetic oligonucleotide
cccagtagtggttctgatga

SEQ ID NO: 10349 - DNA, 20 bp, Artificial Sequence
  Description of Artificial Sequence: Synthetic oligonucleotide
ccagtagtggttctgatgac

SEQ ID NO: 10350 - DNA, 20 bp, Artificial Sequence
  Description of Artificial Sequence: Synthetic oligonucleotide
cagtagtggttctgatgacc

SEQ ID NO: 10351 - DNA, 20 bp, Artificial Sequence
  Description of Artificial Sequence: Synthetic oligonucleotide
agtagtggttctgatgacca

SEQ ID NO: 10352 - DNA, 20 bp, Artificial Sequence
  Description of Artificial Sequence: Synthetic oligonucleotide
gtagtggttctgatgaccag

SEQ ID NO: 10353 - DNA, 20 bp, Artificial Sequence
  Description of Artificial Sequence: Synthetic oligonucleotide
tagtggttctgatgaccagg

SEQ ID NO: 10354 - DNA, 20 bp, Artificial Sequence
  Description of Artificial Sequence: Synthetic oligonucleotide
agtggttctgatgaccagga

SEQ ID NO: 10355 - DNA, 20 bp, Artificial Sequence
  Description of Artificial Sequence: Synthetic oligonucleotide
gtggttctgatgaccaggat

SEQ ID NO: 10356 - DNA, 20 bp, Artificial Sequence
  Description of Artificial Sequence: Synthetic oligonucleotide
tggttctgatgaccaggata

SEQ ID NO: 10357 - DNA, 20 bp, Artificial Sequence
  Description of Artificial Sequence: Synthetic oligonucleotide
ggttctgatgaccaggatat

SEQ ID NO: 10358 - DNA, 20 bp, Artificial Sequence
  Description of Artificial Sequence: Synthetic oligonucleotide
gttctgatgaccaggatatg

SEQ ID NO: 10359 - DNA, 20 bp, Artificial Sequence
  Description of Artificial Sequence: Synthetic oligonucleotide
ttctgatgaccaggatatgt

SEQ ID NO: 10360 - DNA, 20 bp, Artificial Sequence
  Description of Artificial Sequence: Synthetic oligonucleotide
tctgatgaccaggatatgta

SEQ ID NO: 10361 - DNA, 20 bp, Artificial Sequence
  Description of Artificial Sequence: Synthetic oligonucleotide
ctgatgaccaggatatgtag

SEQ ID NO: 10362 - DNA, 20 bp, Artificial Sequence
  Description of Artificial Sequence: Synthetic oligonucleotide
tgatgaccaggatatgtaga

SEQ ID NO: 10363 - DNA, 20 bp, Artificial Sequence
  Description of Artificial Sequence: Synthetic oligonucleotide
gatgaccaggatatgtagaa

SEQ ID NO: 10364 - DNA, 20 bp, Artificial Sequence
  Description of Artificial Sequence: Synthetic oligonucleotide
atgaccaggatatgtagaag

SEQ ID NO: 10365 - DNA, 20 bp, Artificial Sequence
  Description of Artificial Sequence: Synthetic oligonucleotide
tgaccaggatatgtagaagc

SEQ ID NO: 10366 - DNA, 20 bp, Artificial Sequence
  Description of Artificial Sequence: Synthetic oligonucleotide
gaccaggatatgtagaagca

SEQ ID NO: 10367 - DNA, 20 bp, Artificial Sequence
  Description of Artificial Sequence: Synthetic oligonucleotide
accaggatatgtagaagcag

SEQ ID NO: 10368 - DNA, 20 bp, Artificial Sequence
  Description of Artificial Sequence: Synthetic oligonucleotide
ccaggatatgtagaagcagt

SEQ ID NO: 10369 - DNA, 20 bp, Artificial Sequence
  Description of Artificial Sequence: Synthetic oligonucleotide
caggatatgtagaagcagtg

SEQ ID NO: 10370 - DNA, 20 bp, Artificial Sequence
  Description of Artificial Sequence: Synthetic oligonucleotide
aggatatgtagaagcagtgc

SEQ ID NO: 10371 - DNA, 20 bp, Artificial Sequence
  Description of Artificial Sequence: Synthetic oligonucleotide
ggatatgtagaagcagtgct

SEQ ID NO: 10372 - DNA, 20 bp, Artificial Sequence
  Description of Artificial Sequence: Synthetic oligonucleotide
gatatgtagaagcagtgctg

SEQ ID NO: 10373 - DNA, 20 bp, Artificial Sequence
  Description of Artificial Sequence: Synthetic oligonucleotide
atatgtagaagcagtgctgt

SEQ ID NO: 10374 - DNA, 20 bp, Artificial Sequence
  Description of Artificial Sequence: Synthetic oligonucleotide
tatgtagaagcagtgctgta

SEQ ID NO: 10375 - DNA, 20 bp, Artificial Sequence
  Description of Artificial Sequence: Synthetic oligonucleotide
atgtagaagcagtgctgtag

SEQ ID NO: 10376 - DNA, 20 bp, Artificial Sequence
  Description of Artificial Sequence: Synthetic oligonucleotide
tgtagaagcagtgctgtaga

SEQ ID NO: 10377 - DNA, 20 bp, Artificial Sequence
  Description of Artificial Sequence: Synthetic oligonucleotide
gtagaagcagtgctgtagat

SEQ ID NO: 10378 - DNA, 20 bp, Artificial Sequence
  Description of Artificial Sequence: Synthetic oligonucleotide
tagaagcagtgctgtagatg

SEQ ID NO: 10379 - DNA, 20 bp, Artificial Sequence
  Description of Artificial Sequence: Synthetic oligonucleotide
agaagcagtgctgtagatgg

SEQ ID NO: 10380 - DNA, 20 bp, Artificial Sequence
  Description of Artificial Sequence: Synthetic oligonucleotide
gaagcagtgctgtagatggg

SEQ ID NO: 10381 - DNA, 20 bp, Artificial Sequence
  Description of Artificial Sequence: Synthetic oligonucleotide
aagcagtgctgtagatgggg

SEQ ID NO: 10382 - DNA, 20 bp, Artificial Sequence
  Description of Artificial Sequence: Synthetic oligonucleotide
agcagtgctgtagatgggga

SEQ ID NO: 10383 - DNA, 20 bp, Artificial Sequence
  Description of Artificial Sequence: Synthetic oligonucleotide
gcagtgctgtagatggggag

SEQ ID NO: 10384 - DNA, 20 bp, Artificial Sequence
  Description of Artificial Sequence: Synthetic oligonucleotide
cagtgctgtagatggggagg

SEQ ID NO: 10385 - DNA, 20 bp, Artificial Sequence
  Description of Artificial Sequence: Synthetic oligonucleotide
agtgctgtagatggggaggc

SEQ ID NO: 10386 - DNA, 20 bp, Artificial Sequence
  Description of Artificial Sequence: Synthetic oligonucleotide
gtgctgtagatggggaggca

SEQ ID NO: 10387 - DNA, 20 bp, Artificial Sequence
  Description of Artificial Sequence: Synthetic oligonucleotide
tgctgtagatggggaggcac

SEQ ID NO: 10388 - DNA, 20 bp, Artificial Sequence
  Description of Artificial Sequence: Synthetic oligonucleotide
gctgtagatggggaggcact

SEQ ID NO: 10389 - DNA, 20 bp, Artificial Sequence
  Description of Artificial Sequence: Synthetic oligonucleotide
ctgtagatggggaggcactc

SEQ ID NO: 10390 - DNA, 20 bp, Artificial Sequence
  Description of Artificial Sequence: Synthetic oligonucleotide
tgtagatggggaggcactcc

SEQ ID NO: 10391 - DNA, 20 bp, Artificial Sequence
  Description of Artificial Sequence: Synthetic oligonucleotide
gtagatggggaggcactcca

SEQ ID NO: 10392 - DNA, 20 bp, Artificial Sequence
  Description of Artificial Sequence: Synthetic oligonucleotide
tagatggggaggcactccac

SEQ ID NO: 10393 - DNA, 20 bp, Artificial Sequence
  Description of Artificial Sequence: Synthetic oligonucleotide
agatggggaggcactccacg

SEQ ID NO: 10394 - DNA, 20 bp, Artificial Sequence
  Description of Artificial Sequence: Synthetic oligonucleotide
gatggggaggcactccacgc

SEQ ID NO: 10395 - DNA, 20 bp, Artificial Sequence
  Description of Artificial Sequence: Synthetic oligonucleotide
atggggaggcactccacgct

SEQ ID NO: 10396 - DNA, 20 bp, Artificial Sequence
  Description of Artificial Sequence: Synthetic oligonucleotide
tggggaggcactccacgctc

SEQ ID NO: 10397 - DNA, 20 bp, Artificial Sequence
  Description of Artificial Sequence: Synthetic oligonucleotide
ggggaggcactccacgctcc

SEQ ID NO: 10398 - DNA, 20 bp, Artificial Sequence
  Description of Artificial Sequence: Synthetic oligonucleotide
gggaggcactccacgctccc

SEQ ID NO: 10399 - DNA, 20 bp, Artificial Sequence
  Description of Artificial Sequence: Synthetic oligonucleotide
ggaggcactccacgctccct

SEQ ID NO: 10400 - DNA, 20 bp, Artificial Sequence
  Description of Artificial Sequence: Synthetic oligonucleotide
gaggcactccacgctccctc

SEQ ID NO: 10401 - DNA, 20 bp, Artificial Sequence
  Description of Artificial Sequence: Synthetic oligonucleotide
aggcactccacgctccctca

SEQ ID NO: 10402 - DNA, 20 bp, Artificial Sequence
  Description of Artificial Sequence: Synthetic oligonucleotide
ggcactccacgctccctcag

SEQ ID NO: 10403 - DNA, 20 bp, Artificial Sequence
  Description of Artificial Sequence: Synthetic oligonucleotide
gcactccacgctccctcagg

SEQ ID NO: 10404 - DNA, 20 bp, Artificial Sequence
  Description of Artificial Sequence: Synthetic oligonucleotide
cactccacgctccctcaggg

SEQ ID NO: 10405 - DNA, 20 bp, Artificial Sequence
  Description of Artificial Sequence: Synthetic oligonucleotide
actccacgctccctcagggg

SEQ ID NO: 10406 - DNA, 20 bp, Artificial Sequence
  Description of Artificial Sequence: Synthetic oligonucleotide
ctccacgctccctcagggga

SEQ ID NO: 10407 - DNA, 20 bp, Artificial Sequence
  Description of Artificial Sequence: Synthetic oligonucleotide
tccacgctccctcaggggac

SEQ ID NO: 10408 - DNA, 20 bp, Artificial Sequence
  Description of Artificial Sequence: Synthetic oligonucleotide
ccacgctccctcaggggact

SEQ ID NO: 10409 - DNA, 20 bp, Artificial Sequence
  Description of Artificial Sequence: Synthetic oligonucleotide
cacgctccctcaggggactg

SEQ ID NO: 10410 - DNA, 20 bp, Artificial Sequence
  Description of Artificial Sequence: Synthetic oligonucleotide
acgctccctcaggggactgg

SEQ ID NO: 10411 - DNA, 20 bp, Artificial Sequence
  Description of Artificial Sequence: Synthetic oligonucleotide
cgctccctcaggggactggt

SEQ ID NO: 10412 - DNA, 20 bp, Artificial Sequence
  Description of Artificial Sequence: Synthetic oligonucleotide
gctccctcaggggactggtc

SEQ ID NO: 10413 - DNA, 20 bp, Artificial Sequence
  Description of Artificial Sequence: Synthetic oligonucleotide
ctccctcaggggactggtct

SEQ ID NO: 10414 - DNA, 20 bp, Artificial Sequence
  Description of Artificial Sequence: Synthetic oligonucleotide
tccctcaggggactggtctc

SEQ ID NO: 10415 - DNA, 20 bp, Artificial Sequence
  Description of Artificial Sequence: Synthetic oligonucleotide
ccctcaggggactggtctcc

SEQ ID NO: 10416 - DNA, 20 bp, Artificial Sequence
  Description of Artificial Sequence: Synthetic oligonucleotide
cctcaggggactggtctcct

SEQ ID NO: 10417 - DNA, 20 bp, Artificial Sequence
  Description of Artificial Sequence: Synthetic oligonucleotide
ctcaggggactggtctcctt

SEQ ID NO: 10418 - DNA, 20 bp, Artificial Sequence
  Description of Artificial Sequence: Synthetic oligonucleotide
tcaggggactggtctcctta

SEQ ID NO: 10419 - DNA, 20 bp, Artificial Sequence
  Description of Artificial Sequence: Synthetic oligonucleotide
caggggactggtctccttac

SEQ ID NO: 10420 - DNA, 20 bp, Artificial Sequence
  Description of Artificial Sequence: Synthetic oligonucleotide
aggggactggtctccttacc

SEQ ID NO: 10421 - DNA, 20 bp, Artificial Sequence
  Description of Artificial Sequence: Synthetic oligonucleotide
ggggactggtctccttacct

SEQ ID NO: 10422 - DNA, 20 bp, Artificial Sequence
  Description of Artificial Sequence: Synthetic oligonucleotide
gggactggtctccttacctg

SEQ ID NO: 10423 - DNA, 20 bp, Artificial Sequence
  Description of Artificial Sequence: Synthetic oligonucleotide
ggactggtctccttacctgc

SEQ ID NO: 10424 - DNA, 20 bp, Artificial Sequence
  Description of Artificial Sequence: Synthetic oligonucleotide
gactggtctccttacctgcg

SEQ ID NO: 10425 - DNA, 20 bp, Artificial Sequence
  Description of Artificial Sequence: Synthetic oligonucleotide
actggtctccttacctgcgg

SEQ ID NO: 10426 - DNA, 20 bp, Artificial Sequence
  Description of Artificial Sequence: Synthetic oligonucleotide
ctggtctccttacctgcgga

SEQ ID NO: 10427 - DNA, 20 bp, Artificial Sequence
  Description of Artificial Sequence: Synthetic oligonucleotide
tggtctccttacctgcggag

SEQ ID NO: 10428 - DNA, 20 bp, Artificial Sequence
  Description of Artificial Sequence: Synthetic oligonucleotide
ggtctccttacctgcggagg

SEQ ID NO: 10429 - DNA, 20 bp, Artificial Sequence
  Description of Artificial Sequence: Synthetic oligonucleotide
gtctccttacctgcggaggt

SEQ ID NO: 10430 - DNA, 20 bp, Artificial Sequence
  Description of Artificial Sequence: Synthetic oligonucleotide
tctccttacctgcggaggtc

SEQ ID NO: 10431 - DNA, 20 bp, Artificial Sequence
  Description of Artificial Sequence: Synthetic oligonucleotide
ctccttacctgcggaggtct

SEQ ID NO: 10432 - DNA, 20 bp, Artificial Sequence
  Description of Artificial Sequence: Synthetic oligonucleotide
tccttacctgcggaggtctg

SEQ ID NO: 10433 - DNA, 20 bp, Artificial Sequence
  Description of Artificial Sequence: Synthetic oligonucleotide
ccttacctgcggaggtctga

SEQ ID NO: 10434 - DNA, 20 bp, Artificial Sequence
  Description of Artificial Sequence: Synthetic oligonucleotide
cttacctgcggaggtctgag

SEQ ID NO: 10435 - DNA, 20 bp, Artificial Sequence
  Description of Artificial Sequence: Synthetic oligonucleotide
ttacctgcggaggtctgagt

SEQ ID NO: 10436 - DNA, 20 bp, Artificial Sequence
  Description of Artificial Sequence: Synthetic oligonucleotide
tacctgcggaggtctgagtg

SEQ ID NO: 10437 - DNA, 20 bp, Artificial Sequence
  Description of Artificial Sequence: Synthetic oligonucleotide
acctgcggaggtctgagtga

SEQ ID NO: 10438 - DNA, 20 bp, Artificial Sequence
  Description of Artificial Sequence: Synthetic oligonucleotide
cctgcggaggtctgagtgac

SEQ ID NO: 10439 - DNA, 20 bp, Artificial Sequence
  Description of Artificial Sequence: Synthetic oligonucleotide
ctgcggaggtctgagtgacc

SEQ ID NO: 10440 - DNA, 20 bp, Artificial Sequence
  Description of Artificial Sequence: Synthetic oligonucleotide
tgcggaggtctgagtgaccg

SEQ ID NO: 10441 - DNA, 20 bp, Artificial Sequence
  Description of Artificial Sequence: Synthetic oligonucleotide
gcggaggtctgagtgaccgt

SEQ ID NO: 10442 - DNA, 20 bp, Artificial Sequence
  Description of Artificial Sequence: Synthetic oligonucleotide
cggaggtctgagtgaccgtc

SEQ ID NO: 10443 - DNA, 20 bp, Artificial Sequence
  Description of Artificial Sequence: Synthetic oligonucleotide
ggaggtctgagtgaccgtct

SEQ ID NO: 10444 - DNA, 20 bp, Artificial Sequence
  Description of Artificial Sequence: Synthetic oligonucleotide
gaggtctgagtgaccgtctg

SEQ ID NO: 10445 - DNA, 20 bp, Artificial Sequence
  Description of Artificial Sequence: Synthetic oligonucleotide
aggtctgagtgaccgtctgt

SEQ ID NO: 10446 - DNA, 20 bp, Artificial Sequence
  Description of Artificial Sequence: Synthetic oligonucleotide
ggtctgagtgaccgtctgtg

SEQ ID NO: 10447 - DNA, 20 bp, Artificial Sequence
  Description of Artificial Sequence: Synthetic oligonucleotide
gtctgagtgaccgtctgtgc

SEQ ID NO: 10448 - DNA, 20 bp, Artificial Sequence
  Description of Artificial Sequence: Synthetic oligonucleotide
tctgagtgaccgtctgtgct

SEQ ID NO: 10449 - DNA, 20 bp, Artificial Sequence
  Description of Artificial Sequence: Synthetic oligonucleotide
ctgagtgaccgtctgtgctg

SEQ ID NO: 10450 - DNA, 20 bp, Artificial Sequence
  Description of Artificial Sequence: Synthetic oligonucleotide
tgagtgaccgtctgtgctgc

SEQ ID NO: 10451 - DNA, 20 bp, Artificial Sequence
  Description of Artificial Sequence: Synthetic oligonucleotide
gagtgaccgtctgtgctgcc

SEQ ID NO: 10452 - DNA, 20 bp, Artificial Sequence
  Description of Artificial Sequence: Synthetic oligonucleotide
agtgaccgtctgtgctgcct

SEQ ID NO: 10453 - DNA, 20 bp, Artificial Sequence
  Description of Artificial Sequence: Synthetic oligonucleotide
gtgaccgtctgtgctgcctg

SEQ ID NO: 10454 - DNA, 20 bp, Artificial Sequence
  Description of Artificial Sequence: Synthetic oligonucleotide
tgaccgtctgtgctgcctgc

SEQ ID NO: 10455 - DNA, 20 bp, Artificial Sequence
  Description of Artificial Sequence: Synthetic oligonucleotide
gaccgtctgtgctgcctgca

SEQ ID NO: 10456 - DNA, 20 bp, Artificial Sequence
  Description of Artificial Sequence: Synthetic oligonucleotide
accgtctgtgctgcctgcag

SEQ ID NO: 10457 - DNA, 20 bp, Artificial Sequence
  Description of Artificial Sequence: Synthetic oligonucleotide
ccgtctgtgctgcctgcagc

SEQ ID NO: 10458 - DNA, 20 bp, Artificial Sequence
  Description of Artificial Sequence: Synthetic oligonucleotide
cgtctgtgctgcctgcagct

SEQ ID NO: 10459 - DNA, 20 bp, Artificial Sequence
  Description of Artificial Sequence: Synthetic oligonucleotide
gtctgtgctgcctgcagctg

SEQ ID NO: 10460 - DNA, 20 bp, Artificial Sequence
  Description of Artificial Sequence: Synthetic oligonucleotide
tctgtgctgcctgcagctgc

SEQ ID NO: 10461 - DNA, 20 bp, Artificial Sequence
  Description of Artificial Sequence: Synthetic oligonucleotide
ctgtgctgcctgcagctgca

SEQ ID NO: 10462 - DNA, 20 bp, Artificial Sequence
  Description of Artificial Sequence: Synthetic oligonucleotide
tgtgctgcctgcagctgcat

SEQ ID NO: 10463 - DNA, 20 bp, Artificial Sequence
  Description of Artificial Sequence: Synthetic oligonucleotide
gtgctgcctgcagctgcatg

SEQ ID NO: 10464 - DNA, 20 bp, Artificial Sequence
  Description of Artificial Sequence: Synthetic oligonucleotide
tgctgcctgcagctgcatga

SEQ ID NO: 10465 - DNA, 20 bp, Artificial Sequence
  Description of Artificial Sequence: Synthetic oligonucleotide
gctgcctgcagctgcatgat

SEQ ID NO: 10466 - DNA, 20 bp, Artificial Sequence
  Description of Artificial Sequence: Synthetic oligonucleotide
ctgcctgcagctgcatgatg

SEQ ID NO: 10467 - DNA, 20 bp, Artificial Sequence
  Description of Artificial Sequence: Synthetic oligonucleotide
tgcctgcagctgcatgatgt

SEQ ID NO: 10468 - DNA, 20 bp, Artificial Sequence
  Description of Artificial Sequence: Synthetic oligonucleotide
gcctgcagctgcatgatgtc

SEQ ID NO: 10469 - DNA, 20 bp, Artificial Sequence
  Description of Artificial Sequence: Synthetic oligonucleotide
cctgcagctgcatgatgtca

SEQ ID NO: 10470 - DNA, 20 bp, Artificial Sequence
  Description of Artificial Sequence: Synthetic oligonucleotide
ctgcagctgcatgatgtcaa

SEQ ID NO: 10471 - DNA, 20 bp, Artificial Sequence
  Description of Artificial Sequence: Synthetic oligonucleotide
tgcagctgcatgatgtcaat

SEQ ID NO: 10472 - DNA, 20 bp, Artificial Sequence
  Description of Artificial Sequence: Synthetic oligonucleotide
gcagctgcatgatgtcaatt

SEQ ID NO: 10473 - DNA, 20 bp, Artificial Sequence
  Description of Artificial Sequence: Synthetic oligonucleotide
cagctgcatgatgtcaattt

SEQ ID NO: 10474 - DNA, 20 bp, Artificial Sequence
  Description of Artificial Sequence: Synthetic oligonucleotide
agctgcatgatgtcaatttg

SEQ ID NO: 10475 - DNA, 20 bp, Artificial Sequence
  Description of Artificial Sequence: Synthetic oligonucleotide
gctgcatgatgtcaatttgg

SEQ ID NO: 10476 - DNA, 20 bp, Artificial Sequence
  Description of Artificial Sequence: Synthetic oligonucleotide
ctgcatgatgtcaatttggt

SEQ ID NO: 10477 - DNA, 20 bp, Artificial Sequence
  Description of Artificial Sequence: Synthetic oligonucleotide
tgcatgatgtcaatttggtt

SEQ ID NO: 10478 - DNA, 20 bp, Artificial Sequence
  Description of Artificial Sequence: Synthetic oligonucleotide
gcatgatgtcaatttggttg

SEQ ID NO: 10479 - DNA, 20 bp, Artificial Sequence
  Description of Artificial Sequence: Synthetic oligonucleotide
catgatgtcaatttggttgt

SEQ ID NO: 10480 - DNA, 20 bp, Artificial Sequence
  Description of Artificial Sequence: Synthetic oligonucleotide
atgatgtcaatttggttgtt

SEQ ID NO: 10481 - DNA, 20 bp, Artificial Sequence
  Description of Artificial Sequence: Synthetic oligonucleotide
tgatgtcaatttggttgttc

SEQ ID NO: 10482 - DNA, 20 bp, Artificial Sequence
  Description of Artificial Sequence: Synthetic oligonucleotide
gatgtcaatttggttgttca

SEQ ID NO: 10483 - DNA, 20 bp, Artificial Sequence
  Description of Artificial Sequence: Synthetic oligonucleotide
atgtcaatttggttgttcat

SEQ ID NO: 10484 - DNA, 20 bp, Artificial Sequence
  Description of Artificial Sequence: Synthetic oligonucleotide
tgtcaatttggttgttcatc

SEQ ID NO: 10485 - DNA, 20 bp, Artificial Sequence
  Description of Artificial Sequence: Synthetic oligonucleotide
gtcaatttggttgttcatct

SEQ ID NO: 10486 - DNA, 20 bp, Artificial Sequence
  Description of Artificial Sequence: Synthetic oligonucleotide
tcaatttggttgttcatctc

SEQ ID NO: 10487 - DNA, 20 bp, Artificial Sequence
  Description of Artificial Sequence: Synthetic oligonucleotide
caatttggttgttcatctcg

SEQ ID NO: 10488 - DNA, 20 bp, Artificial Sequence
  Description of Artificial Sequence: Synthetic oligonucleotide
aatttggttgttcatctcgg

SEQ ID NO: 10489 - DNA, 20 bp, Artificial Sequence
  Description of Artificial Sequence: Synthetic oligonucleotide
atttggttgttcatctcgga

SEQ ID NO: 10490 - DNA, 20 bp, Artificial Sequence
  Description of Artificial Sequence: Synthetic oligonucleotide
tttggttgttcatctcggag

SEQ ID NO: 10491 - DNA, 20 bp, Artificial Sequence
  Description of Artificial Sequence: Synthetic oligonucleotide
ttggttgttcatctcggagt

SEQ ID NO: 10492 - DNA, 20 bp, Artificial Sequence
  Description of Artificial Sequence: Synthetic oligonucleotide
tggttgttcatctcggagta

SEQ ID NO: 10493 - DNA, 20 bp, Artificial Sequence
  Description of Artificial Sequence: Synthetic oligonucleotide
ggttgttcatctcggagtac

SEQ ID NO: 10494 - DNA, 20 bp, Artificial Sequence
  Description of Artificial Sequence: Synthetic oligonucleotide
gttgttcatctcggagtact

SEQ ID NO: 10495 - DNA, 20 bp, Artificial Sequence
  Description of Artificial Sequence: Synthetic oligonucleotide
ttgttcatctcggagtactt

SEQ ID NO: 10496 - DNA, 20 bp, Artificial Sequence
  Description of Artificial Sequence: Synthetic oligonucleotide
tgttcatctcggagtacttg

SEQ ID NO: 10497 - DNA, 20 bp, Artificial Sequence
  Description of Artificial Sequence: Synthetic oligonucleotide
gttcatctcggagtacttgc

SEQ ID NO: 10498 - DNA, 20 bp, Artificial Sequence
  Description of Artificial Sequence: Synthetic oligonucleotide
ttcatctcggagtacttgct

SEQ ID NO: 10499 - DNA, 20 bp, Artificial Sequence
  Description of Artificial Sequence: Synthetic oligonucleotide
tcatctcggagtacttgctc

SEQ ID NO: 10500 - DNA, 20 bp, Artificial Sequence
  Description of Artificial Sequence: Synthetic oligonucleotide
catctcggagtacttgctct

SEQ ID NO: 10501 - DNA, 20 bp, Artificial Sequence
  Description of Artificial Sequence: Synthetic oligonucleotide
atctcggagtacttgctctc

SEQ ID NO: 10502 - DNA, 20 bp, Artificial Sequence
  Description of Artificial Sequence: Synthetic oligonucleotide
tctcggagtacttgctctca

SEQ ID NO: 10503 - DNA, 20 bp, Artificial Sequence
  Description of Artificial Sequence: Synthetic oligonucleotide
ctcggagtacttgctctcag

SEQ ID NO: 10504 - DNA, 20 bp, Artificial Sequence
  Description of Artificial Sequence: Synthetic oligonucleotide
tcggagtacttgctctcagc

SEQ ID NO: 10505 - DNA, 20 bp, Artificial Sequence
  Description of Artificial Sequence: Synthetic oligonucleotide
cggagtacttgctctcagca

SEQ ID NO: 10506 - DNA, 20 bp, Artificial Sequence
  Description of Artificial Sequence: Synthetic oligonucleotide
ggagtacttgctctcagcat

SEQ ID NO: 10507 - DNA, 20 bp, Artificial Sequence
  Description of Artificial Sequence: Synthetic oligonucleotide
gagtacttgctctcagcatc

SEQ ID NO: 10508 - DNA, 20 bp, Artificial Sequence
  Description of Artificial Sequence: Synthetic oligonucleotide
agtacttgctctcagcatct

SEQ ID NO: 10509 - DNA, 20 bp, Artificial Sequence
  Description of Artificial Sequence: Synthetic oligonucleotide
gtacttgctctcagcatctg

SEQ ID NO: 10510 - DNA, 20 bp, Artificial Sequence
  Description of Artificial Sequence: Synthetic oligonucleotide
tacttgctctcagcatctgt

SEQ ID NO: 10511 - DNA, 20 bp, Artificial Sequence
  Description of Artificial Sequence: Synthetic oligonucleotide
acttgctctcagcatctgtg

SEQ ID NO: 10512 - DNA, 20 bp, Artificial Sequence
  Description of Artificial Sequence: Synthetic oligonucleotide
cttgctctcagcatctgtga

SEQ ID NO: 10513 - DNA, 20 bp, Artificial Sequence
  Description of Artificial Sequence: Synthetic oligonucleotide
ttgctctcagcatctgtgag

SEQ ID NO: 10514 - DNA, 20 bp, Artificial Sequence
  Description of Artificial Sequence: Synthetic oligonucleotide
tgctctcagcatctgtgagc

SEQ ID NO: 10515 - DNA, 20 bp, Artificial Sequence
  Description of Artificial Sequence: Synthetic oligonucleotide
gctctcagcatctgtgagcc

SEQ ID NO: 10516 - DNA, 20 bp, Artificial Sequence
  Description of Artificial Sequence: Synthetic oligonucleotide
ctctcagcatctgtgagccg

SEQ ID NO: 10517 - DNA, 20 bp, Artificial Sequence
  Description of Artificial Sequence: Synthetic oligonucleotide
tctcagcatctgtgagccgc

SEQ ID NO: 10518 - DNA, 20 bp, Artificial Sequence
  Description of Artificial Sequence: Synthetic oligonucleotide
ctcagcatctgtgagccgcg

SEQ ID NO: 10519 - DNA, 20 bp, Artificial Sequence
  Description of Artificial Sequence: Synthetic oligonucleotide
tcagcatctgtgagccgcga

SEQ ID NO: 10520 - DNA, 20 bp, Artificial Sequence
  Description of Artificial Sequence: Synthetic oligonucleotide
cagcatctgtgagccgcgac

SEQ ID NO: 10521 - DNA, 20 bp, Artificial Sequence
  Description of Artificial Sequence: Synthetic oligonucleotide
agcatctgtgagccgcgact

SEQ ID NO: 10522 - DNA, 20 bp, Artificial Sequence
  Description of Artificial Sequence: Synthetic oligonucleotide
gcatctgtgagccgcgactc

SEQ ID NO: 10523 - DNA, 20 bp, Artificial Sequence
  Description of Artificial Sequence: Synthetic oligonucleotide
catctgtgagccgcgactcc

SEQ ID NO: 10524 - DNA, 20 bp, Artificial Sequence
  Description of Artificial Sequence: Synthetic oligonucleotide
atctgtgagccgcgactcca

SEQ ID NO: 10525 - DNA, 20 bp, Artificial Sequence
  Description of Artificial Sequence: Synthetic oligonucleotide
tctgtgagccgcgactccat

SEQ ID NO: 10526 - DNA, 20 bp, Artificial Sequence
  Description of Artificial Sequence: Synthetic oligonucleotide
ctgtgagccgcgactccatg

SEQ ID NO: 10527 - DNA, 20 bp, Artificial Sequence
  Description of Artificial Sequence: Synthetic oligonucleotide
tgtgagccgcgactccatgc

SEQ ID NO: 10528 - DNA, 20 bp, Artificial Sequence
  Description of Artificial Sequence: Synthetic oligonucleotide
gtgagccgcgactccatgcg

SEQ ID NO: 10529 - DNA, 20 bp, Artificial Sequence
  Description of Artificial Sequence: Synthetic oligonucleotide
tgagccgcgactccatgcgc

SEQ ID NO: 10530 - DNA, 20 bp, Artificial Sequence
  Description of Artificial Sequence: Synthetic oligonucleotide
gagccgcgactccatgcgct

SEQ ID NO: 10531 - DNA, 20 bp, Artificial Sequence
  Description of Artificial Sequence: Synthetic oligonucleotide
agccgcgactccatgcgctt

SEQ ID NO: 10532 - DNA, 20 bp, Artificial Sequence
  Description of Artificial Sequence: Synthetic oligonucleotide
gccgcgactccatgcgcttg

SEQ ID NO: 10533 - DNA, 20 bp, Artificial Sequence
  Description of Artificial Sequence: Synthetic oligonucleotide
ccgcgactccatgcgcttgc

SEQ ID NO: 10534 - DNA, 20 bp, Artificial Sequence
  Description of Artificial Sequence: Synthetic oligonucleotide
cgcgactccatgcgcttgct

SEQ ID NO: 10535 - DNA, 20 bp, Artificial Sequence
  Description of Artificial Sequence: Synthetic oligonucleotide
gcgactccatgcgcttgctg

SEQ ID NO: 10536 - DNA, 20 bp, Artificial Sequence
  Description of Artificial Sequence: Synthetic oligonucleotide
cgactccatgcgcttgctgt

SEQ ID NO: 10537 - DNA, 20 bp, Artificial Sequence
  Description of Artificial Sequence: Synthetic oligonucleotide
gactccatgcgcttgctgtt

SEQ ID NO: 10538 - DNA, 20 bp, Artificial Sequence
  Description of Artificial Sequence: Synthetic oligonucleotide
actccatgcgcttgctgttg

SEQ ID NO: 10539 - DNA, 20 bp, Artificial Sequence
  Description of Artificial Sequence: Synthetic oligonucleotide
ctccatgcgcttgctgttgc

SEQ ID NO: 10540 - DNA, 20 bp, Artificial Sequence
  Description of Artificial Sequence: Synthetic oligonucleotide
tccatgcgcttgctgttgct

SEQ ID NO: 10541 - DNA, 20 bp, Artificial Sequence
  Description of Artificial Sequence: Synthetic oligonucleotide
ccatgcgcttgctgttgctc

SEQ ID NO: 10542 - DNA, 20 bp, Artificial Sequence
  Description of Artificial Sequence: Synthetic oligonucleotide
catgcgcttgctgttgctct

SEQ ID NO: 10543 - DNA, 20 bp, Artificial Sequence
  Description of Artificial Sequence: Synthetic oligonucleotide
atgcgcttgctgttgctctc

SEQ ID NO: 10544 - DNA, 20 bp, Artificial Sequence
  Description of Artificial Sequence: Synthetic oligonucleotide
tgcgcttgctgttgctctcc

SEQ ID NO: 10545 - DNA, 20 bp, Artificial Sequence
  Description of Artificial Sequence: Synthetic oligonucleotide
gcgcttgctgttgctctcca

SEQ ID NO: 10546 - DNA, 20 bp, Artificial Sequence
  Description of Artificial Sequence: Synthetic oligonucleotide
cgcttgctgttgctctccag

SEQ ID NO: 10547 - DNA, 20 bp, Artificial Sequence
  Description of Artificial Sequence: Synthetic oligonucleotide
gcttgctgttgctctccagc

SEQ ID NO: 10548 - DNA, 20 bp, Artificial Sequence
  Description of Artificial Sequence: Synthetic oligonucleotide
cttgctgttgctctccagct

SEQ ID NO: 10549 - DNA, 20 bp, Artificial Sequence
  Description of Artificial Sequence: Synthetic oligonucleotide
ttgctgttgctctccagctc

SEQ ID NO: 10550 - DNA, 20 bp, Artificial Sequence
  Description of Artificial Sequence: Synthetic oligonucleotide
tgctgttgctctccagctcc

SEQ ID NO: 10551 - DNA, 20 bp, Artificial Sequence
  Description of Artificial Sequence: Synthetic oligonucleotide
gctgttgctctccagctcca

SEQ ID NO: 10552 - DNA, 20 bp, Artificial Sequence
  Description of Artificial Sequence: Synthetic oligonucleotide
ctgttgctctccagctccat

SEQ ID NO: 10553 - DNA, 20 bp, Artificial Sequence
  Description of Artificial Sequence: Synthetic oligonucleotide
tgttgctctccagctccatc

SEQ ID NO: 10554 - DNA, 20 bp, Artificial Sequence
  Description of Artificial Sequence: Synthetic oligonucleotide
gttgctctccagctccatca

SEQ ID NO: 10555 - DNA, 20 bp, Artificial Sequence
  Description of Artificial Sequence: Synthetic oligonucleotide
ttgctctccagctccatcac

SEQ ID NO: 10556 - DNA, 20 bp, Artificial Sequence
  Description of Artificial Sequence: Synthetic oligonucleotide
tgctctccagctccatcacc

SEQ ID NO: 10557 - DNA, 20 bp, Artificial Sequence
  Description of Artificial Sequence: Synthetic oligonucleotide
gctctccagctccatcacct

SEQ ID NO: 10558 - DNA, 20 bp, Artificial Sequence
  Description of Artificial Sequence: Synthetic oligonucleotide
ctctccagctccatcacctg

SEQ ID NO: 10559 - DNA, 20 bp, Artificial Sequence
  Description of Artificial Sequence: Synthetic oligonucleotide
tctccagctccatcacctgc

SEQ ID NO: 10560 - DNA, 20 bp, Artificial Sequence
  Description of Artificial Sequence: Synthetic oligonucleotide
ctccagctccatcacctgca

SEQ ID NO: 10561 - DNA, 20 bp, Artificial Sequence
  Description of Artificial Sequence: Synthetic oligonucleotide
tccagctccatcacctgcat

SEQ ID NO: 10562 - DNA, 20 bp, Artificial Sequence
  Description of Artificial Sequence: Synthetic oligonucleotide
ccagctccatcacctgcatg

SEQ ID NO: 10563 - DNA, 20 bp, Artificial Sequence
  Description of Artificial Sequence: Synthetic oligonucleotide
cagctccatcacctgcatga

SEQ ID NO: 10564 - DNA, 20 bp, Artificial Sequence
  Description of Artificial Sequence: Synthetic oligonucleotide
agctccatcacctgcatgac

SEQ ID NO: 10565 - DNA, 20 bp, Artificial Sequence
  Description of Artificial Sequence: Synthetic oligonucleotide
gctccatcacctgcatgacc

SEQ ID NO: 10566 - DNA, 20 bp, Artificial Sequence
  Description of Artificial Sequence: Synthetic oligonucleotide
ctccatcacctgcatgacca

SEQ ID NO: 10567 - DNA, 20 bp, Artificial Sequence
  Description of Artificial Sequence: Synthetic oligonucleotide
tccatcacctgcatgaccac

SEQ ID NO: 10568 - DNA, 20 bp, Artificial Sequence
  Description of Artificial Sequence: Synthetic oligonucleotide
ccatcacctgcatgaccacg

SEQ ID NO: 10569 - DNA, 20 bp, Artificial Sequence
  Description of Artificial Sequence: Synthetic oligonucleotide
catcacctgcatgaccacgc

SEQ ID NO: 10570 - DNA, 20 bp, Artificial Sequence
  Description of Artificial Sequence: Synthetic oligonucleotide
atcacctgcatgaccacgct

SEQ ID NO: 10571 - DNA, 20 bp, Artificial Sequence
  Description of Artificial Sequence: Synthetic oligonucleotide
tcacctgcatgaccacgctg

SEQ ID NO: 10572 - DNA, 20 bp, Artificial Sequence
  Description of Artificial Sequence: Synthetic oligonucleotide
cacctgcatgaccacgctga

SEQ ID NO: 10573 - DNA, 20 bp, Artificial Sequence
  Description of Artificial Sequence: Synthetic oligonucleotide
acctgcatgaccacgctgac

SEQ ID NO: 10574 - DNA, 20 bp, Artificial Sequence
  Description of Artificial Sequence: Synthetic oligonucleotide
cctgcatgaccacgctgacc

SEQ ID NO: 10575 - DNA, 20 bp, Artificial Sequence
  Description of Artificial Sequence: Synthetic oligonucleotide
ctgcatgaccacgctgaccc

SEQ ID NO: 10576 - DNA, 20 bp, Artificial Sequence
  Description of Artificial Sequence: Synthetic oligonucleotide
tgcatgaccacgctgaccca

SEQ ID NO: 10577 - DNA, 20 bp, Artificial Sequence
  Description of Artificial Sequence: Synthetic oligonucleotide
gcatgaccacgctgacccag

SEQ ID NO: 10578 - DNA, 20 bp, Artificial Sequence
  Description of Artificial Sequence: Synthetic oligonucleotide
catgaccacgctgacccagt

SEQ ID NO: 10579 - DNA, 20 bp, Artificial Sequence
  Description of Artificial Sequence: Synthetic oligonucleotide
atgaccacgctgacccagtc

SEQ ID NO: 10580 - DNA, 20 bp, Artificial Sequence
  Description of Artificial Sequence: Synthetic oligonucleotide
tgaccacgctgacccagtcc

SEQ ID NO: 10581 - DNA, 20 bp, Artificial Sequence
  Description of Artificial Sequence: Synthetic oligonucleotide
gaccacgctgacccagtccc

SEQ ID NO: 10582 - DNA, 20 bp, Artificial Sequence
  Description of Artificial Sequence: Synthetic oligonucleotide
accacgctgacccagtccct

SEQ ID NO: 10583 - DNA, 20 bp, Artificial Sequence
  Description of Artificial Sequence: Synthetic oligonucleotide
ccacgctgacccagtccctc

SEQ ID NO: 10584 - DNA, 20 bp, Artificial Sequence
  Description of Artificial Sequence: Synthetic oligonucleotide
cacgctgacccagtccctct

SEQ ID NO: 10585 - DNA, 20 bp, Artificial Sequence
  Description of Artificial Sequence: Synthetic oligonucleotide
acgctgacccagtccctctc

SEQ ID NO: 10586 - DNA, 20 bp, Artificial Sequence
  Description of Artificial Sequence: Synthetic oligonucleotide
cgctgacccagtccctctcc

SEQ ID NO: 10587 - DNA, 20 bp, Artificial Sequence
  Description of Artificial Sequence: Synthetic oligonucleotide
gctgacccagtccctctcct

SEQ ID NO: 10588 - DNA, 20 bp, Artificial Sequence
  Description of Artificial Sequence: Synthetic oligonucleotide
ctgacccagtccctctcctg

SEQ ID NO: 10589 - DNA, 20 bp, Artificial Sequence
  Description of Artificial Sequence: Synthetic oligonucleotide
tgacccagtccctctcctgc

SEQ ID NO: 10590 - DNA, 20 bp, Artificial Sequence
  Description of Artificial Sequence: Synthetic oligonucleotide
gacccagtccctctcctgct

SEQ ID NO: 10591 - DNA, 20 bp, Artificial Sequence
  Description of Artificial Sequence: Synthetic oligonucleotide
acccagtccctctcctgctt

SEQ ID NO: 10592 - DNA, 20 bp, Artificial Sequence
  Description of Artificial Sequence: Synthetic oligonucleotide
cccagtccctctcctgcttc

SEQ ID NO: 10593 - DNA, 20 bp, Artificial Sequence
  Description of Artificial Sequence: Synthetic oligonucleotide
ccagtccctctcctgcttct

SEQ ID NO: 10594 - DNA, 20 bp, Artificial Sequence
  Description of Artificial Sequence: Synthetic oligonucleotide
cagtccctctcctgcttctt

SEQ ID NO: 10595 - DNA, 20 bp, Artificial Sequence
  Description of Artificial Sequence: Synthetic oligonucleotide
agtccctctcctgcttcttg

SEQ ID NO: 10596 - DNA, 20 bp, Artificial Sequence
  Description of Artificial Sequence: Synthetic oligonucleotide
gtccctctcctgcttcttgt

SEQ ID NO: 10597 - DNA, 20 bp, Artificial Sequence
  Description of Artificial Sequence: Synthetic oligonucleotide
tccctctcctgcttcttgtt

SEQ ID NO: 10598 - DNA, 20 bp, Artificial Sequence
  Description of Artificial Sequence: Synthetic oligonucleotide
ccctctcctgcttcttgttc

SEQ ID NO: 10599 - DNA, 20 bp, Artificial Sequence
  Description of Artificial Sequence: Synthetic oligonucleotide
cctctcctgcttcttgttca

SEQ ID NO: 10600 - DNA, 20 bp, Artificial Sequence
  Description of Artificial Sequence: Synthetic oligonucleotide
ctctcctgcttcttgttcag

SEQ ID NO: 10601 - DNA, 20 bp, Artificial Sequence
  Description of Artificial Sequence: Synthetic oligonucleotide
tctcctgcttcttgttcagt

SEQ ID NO: 10602 - DNA, 20 bp, Artificial Sequence
  Description of Artificial Sequence: Synthetic oligonucleotide
ctcctgcttcttgttcagtt

SEQ ID NO: 10603 - DNA, 20 bp, Artificial Sequence
  Description of Artificial Sequence: Synthetic oligonucleotide
tcctgcttcttgttcagttc

SEQ ID NO: 10604 - DNA, 20 bp, Artificial Sequence
  Description of Artificial Sequence: Synthetic oligonucleotide
cctgcttcttgttcagttca

SEQ ID NO: 10605 - DNA, 20 bp, Artificial Sequence
  Description of Artificial Sequence: Synthetic oligonucleotide
ctgcttcttgttcagttcac

SEQ ID NO: 10606 - DNA, 20 bp, Artificial Sequence
  Description of Artificial Sequence: Synthetic oligonucleotide
tgcttcttgttcagttcact

SEQ ID NO: 10607 - DNA, 20 bp, Artificial Sequence
  Description of Artificial Sequence: Synthetic oligonucleotide
gcttcttgttcagttcactc

SEQ ID NO: 10608 - DNA, 20 bp, Artificial Sequence
  Description of Artificial Sequence: Synthetic oligonucleotide
cttcttgttcagttcactca

SEQ ID NO: 10609 - DNA, 20 bp, Artificial Sequence
  Description of Artificial Sequence: Synthetic oligonucleotide
ttcttgttcagttcactcag

SEQ ID NO: 10610 - DNA, 20 bp, Artificial Sequence
  Description of Artificial Sequence: Synthetic oligonucleotide
tcttgttcagttcactcagc

SEQ ID NO: 10611 - DNA, 20 bp, Artificial Sequence
  Description of Artificial Sequence: Synthetic oligonucleotide
cttgttcagttcactcagca

SEQ ID NO: 10612 - DNA, 20 bp, Artificial Sequence
  Description of Artificial Sequence: Synthetic oligonucleotide
ttgttcagttcactcagcag

SEQ ID NO: 10613 - DNA, 20 bp, Artificial Sequence
  Description of Artificial Sequence: Synthetic oligonucleotide
tgttcagttcactcagcagg

SEQ ID NO: 10614 - DNA, 20 bp, Artificial Sequence
  Description of Artificial Sequence: Synthetic oligonucleotide
gttcagttcactcagcaggc

SEQ ID NO: 10615 - DNA, 20 bp, Artificial Sequence
  Description of Artificial Sequence: Synthetic oligonucleotide
ttcagttcactcagcaggct

SEQ ID NO: 10616 - DNA, 20 bp, Artificial Sequence
  Description of Artificial Sequence: Synthetic oligonucleotide
tcagttcactcagcaggctg

SEQ ID NO: 10617 - DNA, 20 bp, Artificial Sequence
  Description of Artificial Sequence: Synthetic oligonucleotide
cagttcactcagcaggctgc

SEQ ID NO: 10618 - DNA, 20 bp, Artificial Sequence
  Description of Artificial Sequence: Synthetic oligonucleotide
agttcactcagcaggctgct

SEQ ID NO: 10619 - DNA, 20 bp, Artificial Sequence
  Description of Artificial Sequence: Synthetic oligonucleotide
gttcactcagcaggctgcta

SEQ ID NO: 10620 - DNA, 20 bp, Artificial Sequence
  Description of Artificial Sequence: Synthetic oligonucleotide
ttcactcagcaggctgctaa

SEQ ID NO: 10621 - DNA, 20 bp, Artificial Sequence
  Description of Artificial Sequence: Synthetic oligonucleotide
tcactcagcaggctgctaag

SEQ ID NO: 10622 - DNA, 20 bp, Artificial Sequence
  Description of Artificial Sequence: Synthetic oligonucleotide
cactcagcaggctgctaagg

SEQ ID NO: 10623 - DNA, 20 bp, Artificial Sequence
  Description of Artificial Sequence: Synthetic oligonucleotide
actcagcaggctgctaaggt

SEQ ID NO: 10624 - DNA, 20 bp, Artificial Sequence
  Description of Artificial Sequence: Synthetic oligonucleotide
ctcagcaggctgctaaggtt

SEQ ID NO: 10625 - DNA, 20 bp, Artificial Sequence
  Description of Artificial Sequence: Synthetic oligonucleotide
tcagcaggctgctaaggttg

SEQ ID NO: 10626 - DNA, 20 bp, Artificial Sequence
  Description of Artificial Sequence: Synthetic oligonucleotide
cagcaggctgctaaggttgg

SEQ ID NO: 10627 - DNA, 20 bp, Artificial Sequence
  Description of Artificial Sequence: Synthetic oligonucleotide
agcaggctgctaaggttggc

SEQ ID NO: 10628 - DNA, 20 bp, Artificial Sequence
  Description of Artificial Sequence: Synthetic oligonucleotide
gcaggctgctaaggttggca

SEQ ID NO: 10629 - DNA, 20 bp, Artificial Sequence
  Description of Artificial Sequence: Synthetic oligonucleotide
caggctgctaaggttggcaa

SEQ ID NO: 10630 - DNA, 20 bp, Artificial Sequence
  Description of Artificial Sequence: Synthetic oligonucleotide
aggctgctaaggttggcaac

SEQ ID NO: 10631 - DNA, 20 bp, Artificial Sequence
  Description of Artificial Sequence: Synthetic oligonucleotide
ggctgctaaggttggcaact

SEQ ID NO: 10632 - DNA, 20 bp, Artificial Sequence
  Description of Artificial Sequence: Synthetic oligonucleotide
gctgctaaggttggcaactt

SEQ ID NO: 10633 - DNA, 20 bp, Artificial Sequence
  Description of Artificial Sequence: Synthetic oligonucleotide
ctgctaaggttggcaacttg

SEQ ID NO: 10634 - DNA, 20 bp, Artificial Sequence
  Description of Artificial Sequence: Synthetic oligonucleotide
tgctaaggttggcaacttgg

SEQ ID NO: 10635 - DNA, 20 bp, Artificial Sequence
  Description of Artificial Sequence: Synthetic oligonucleotide
gctaaggttggcaacttggg

SEQ ID NO: 10636 - DNA, 20 bp, Artificial Sequence
  Description of Artificial Sequence: Synthetic oligonucleotide
ctaaggttggcaacttgggc

SEQ ID NO: 10637 - DNA, 20 bp, Artificial Sequence
  Description of Artificial Sequence: Synthetic oligonucleotide
taaggttggcaacttgggcc

SEQ ID NO: 10638 - DNA, 20 bp, Artificial Sequence
  Description of Artificial Sequence: Synthetic oligonucleotide
aaggttggcaacttgggcct

SEQ ID NO: 10639 - DNA, 20 bp, Artificial Sequence
  Description of Artificial Sequence: Synthetic oligonucleotide
aggttggcaacttgggcctt

SEQ ID NO: 10640 - DNA, 20 bp, Artificial Sequence
  Description of Artificial Sequence: Synthetic oligonucleotide
ggttggcaacttgggccttg

SEQ ID NO: 10641 - DNA, 20 bp, Artificial Sequence
  Description of Artificial Sequence: Synthetic oligonucleotide
gttggcaacttgggccttga

SEQ ID NO: 10642 - DNA, 20 bp, Artificial Sequence
  Description of Artificial Sequence: Synthetic oligonucleotide
ttggcaacttgggccttgag

SEQ ID NO: 10643 - DNA, 20 bp, Artificial Sequence
  Description of Artificial Sequence: Synthetic oligonucleotide
tggcaacttgggccttgagc

SEQ ID NO: 10644 - DNA, 20 bp, Artificial Sequence
  Description of Artificial Sequence: Synthetic oligonucleotide
ggcaacttgggccttgagct

SEQ ID NO: 10645 - DNA, 20 bp, Artificial Sequence
  Description of Artificial Sequence: Synthetic oligonucleotide
gcaacttgggccttgagctc

SEQ ID NO: 10646 - DNA, 20 bp, Artificial Sequence
  Description of Artificial Sequence: Synthetic oligonucleotide
caacttgggccttgagctcc

SEQ ID NO: 10647 - DNA, 20 bp, Artificial Sequence
  Description of Artificial Sequence: Synthetic oligonucleotide
aacttgggccttgagctcct

SEQ ID NO: 10648 - DNA, 20 bp, Artificial Sequence
  Description of Artificial Sequence: Synthetic oligonucleotide
acttgggccttgagctcctt

SEQ ID NO: 10649 - DNA, 20 bp, Artificial Sequence
  Description of Artificial Sequence: Synthetic oligonucleotide
cttgggccttgagctccttc

SEQ ID NO: 10650 - DNA, 20 bp, Artificial Sequence
  Description of Artificial Sequence: Synthetic oligonucleotide
ttgggccttgagctccttca

SEQ ID NO: 10651 - DNA, 20 bp, Artificial Sequence
  Description of Artificial Sequence: Synthetic oligonucleotide
tgggccttgagctccttcac

SEQ ID NO: 10652 - DNA, 20 bp, Artificial Sequence
  Description of Artificial Sequence: Synthetic oligonucleotide
gggccttgagctccttcacc

SEQ ID NO: 10653 - DNA, 20 bp, Artificial Sequence
  Description of Artificial Sequence: Synthetic oligonucleotide
ggccttgagctccttcacct

SEQ ID NO: 10654 - DNA, 20 bp, Artificial Sequence
  Description of Artificial Sequence: Synthetic oligonucleotide
gccttgagctccttcacctc

SEQ ID NO: 10655 - DNA, 20 bp, Artificial Sequence
  Description of Artificial Sequence: Synthetic oligonucleotide
ccttgagctccttcacctcc

SEQ ID NO: 10656 - DNA, 20 bp, Artificial Sequence
  Description of Artificial Sequence: Synthetic oligonucleotide
cttgagctccttcacctcct

SEQ ID NO: 10657 - DNA, 20 bp, Artificial Sequence
  Description of Artificial Sequence: Synthetic oligonucleotide
ttgagctccttcacctcctc

SEQ ID NO: 10658 - DNA, 20 bp, Artificial Sequence
  Description of Artificial Sequence: Synthetic oligonucleotide
tgagctccttcacctcctca

SEQ ID NO: 10659 - DNA, 20 bp, Artificial Sequence
  Description of Artificial Sequence: Synthetic oligonucleotide
gagctccttcacctcctcac

SEQ ID NO: 10660 - DNA, 20 bp, Artificial Sequence
  Description of Artificial Sequence: Synthetic oligonucleotide
agctccttcacctcctcaca

SEQ ID NO: 10661 - DNA, 20 bp, Artificial Sequence
  Description of Artificial Sequence: Synthetic oligonucleotide
gctccttcacctcctcacag

SEQ ID NO: 10662 - DNA, 20 bp, Artificial Sequence
  Description of Artificial Sequence: Synthetic oligonucleotide
ctccttcacctcctcacagc

SEQ ID NO: 10663 - DNA, 20 bp, Artificial Sequence
  Description of Artificial Sequence: Synthetic oligonucleotide
tccttcacctcctcacagca

SEQ ID NO: 10664 - DNA, 20 bp, Artificial Sequence
  Description of Artificial Sequence: Synthetic oligonucleotide
ccttcacctcctcacagcag

SEQ ID NO: 10665 - DNA, 20 bp, Artificial Sequence
  Description of Artificial Sequence: Synthetic oligonucleotide
cttcacctcctcacagcagt

SEQ ID NO: 10666 - DNA, 20 bp, Artificial Sequence
  Description of Artificial Sequence: Synthetic oligonucleotide
ttcacctcctcacagcagtt

SEQ ID NO: 10667 - DNA, 20 bp, Artificial Sequence
  Description of Artificial Sequence: Synthetic oligonucleotide
tcacctcctcacagcagttg

SEQ ID NO: 10668 - DNA, 20 bp, Artificial Sequence
  Description of Artificial Sequence: Synthetic oligonucleotide
cacctcctcacagcagttgg

SEQ ID NO: 10669 - DNA, 20 bp, Artificial Sequence
  Description of Artificial Sequence: Synthetic oligonucleotide
acctcctcacagcagttggc

SEQ ID NO: 10670 - DNA, 20 bp, Artificial Sequence
  Description of Artificial Sequence: Synthetic oligonucleotide
cctcctcacagcagttggcc

SEQ ID NO: 10671 - DNA, 20 bp, Artificial Sequence
  Description of Artificial Sequence: Synthetic oligonucleotide
ctcctcacagcagttggccg

SEQ ID NO: 10672 - DNA, 20 bp, Artificial Sequence
  Description of Artificial Sequence: Synthetic oligonucleotide
tcctcacagcagttggccgc

SEQ ID NO: 10673 - DNA, 20 bp, Artificial Sequence
  Description of Artificial Sequence: Synthetic oligonucleotide
cctcacagcagttggccgct

SEQ ID NO: 10674 - DNA, 20 bp, Artificial Sequence
  Description of Artificial Sequence: Synthetic oligonucleotide
ctcacagcagttggccgctt

SEQ ID NO: 10675 - DNA, 20 bp, Artificial Sequence
  Description of Artificial Sequence: Synthetic oligonucleotide
tcacagcagttggccgcttt

SEQ ID NO: 10676 - DNA, 20 bp, Artificial Sequence
  Description of Artificial Sequence: Synthetic oligonucleotide
cacagcagttggccgctttg

SEQ ID NO: 10677 - DNA, 20 bp, Artificial Sequence
  Description of Artificial Sequence: Synthetic oligonucleotide
acagcagttggccgctttga

SEQ ID NO: 10678 - DNA, 20 bp, Artificial Sequence
  Description of Artificial Sequence: Synthetic oligonucleotide
cagcagttggccgctttgag

SEQ ID NO: 10679 - DNA, 20 bp, Artificial Sequence
  Description of Artificial Sequence: Synthetic oligonucleotide
agcagttggccgctttgagc

SEQ ID NO: 10680 - DNA, 20 bp, Artificial Sequence
  Description of Artificial Sequence: Synthetic oligonucleotide
gcagttggccgctttgagct

SEQ ID NO: 10681 - DNA, 20 bp, Artificial Sequence
  Description of Artificial Sequence: Synthetic oligonucleotide
cagttggccgctttgagctg

SEQ ID NO: 10682 - DNA, 20 bp, Artificial Sequence
  Description of Artificial Sequence: Synthetic oligonucleotide
agttggccgctttgagctgt

SEQ ID NO: 10683 - DNA, 20 bp, Artificial Sequence
  Description of Artificial Sequence: Synthetic oligonucleotide
gttggccgctttgagctgtg

SEQ ID NO: 10684 - DNA, 20 bp, Artificial Sequence
  Description of Artificial Sequence: Synthetic oligonucleotide
ttggccgctttgagctgtgg

SEQ ID NO: 10685 - DNA, 20 bp, Artificial Sequence
  Description of Artificial Sequence: Synthetic oligonucleotide
tggccgctttgagctgtggc

SEQ ID NO: 10686 - DNA, 20 bp, Artificial Sequence
  Description of Artificial Sequence: Synthetic oligonucleotide
ggccgctttgagctgtggct

SEQ ID NO: 10687 - DNA, 20 bp, Artificial Sequence
  Description of Artificial Sequence: Synthetic oligonucleotide
gccgctttgagctgtggctg

SEQ ID NO: 10688 - DNA, 20 bp, Artificial Sequence
  Description of Artificial Sequence: Synthetic oligonucleotide
ccgctttgagctgtggctgt

SEQ ID NO: 10689 - DNA, 20 bp, Artificial Sequence
  Description of Artificial Sequence: Synthetic oligonucleotide
cgctttgagctgtggctgtg

SEQ ID NO: 10690 - DNA, 20 bp, Artificial Sequence
  Description of Artificial Sequence: Synthetic oligonucleotide
gctttgagctgtggctgtgc

SEQ ID NO: 10691 - DNA, 20 bp, Artificial Sequence
  Description of Artificial Sequence: Synthetic oligonucleotide
ctttgagctgtggctgtgct

SEQ ID NO: 10692 - DNA, 20 bp, Artificial Sequence
  Description of Artificial Sequence: Synthetic oligonucleotide
tttgagctgtggctgtgctg

SEQ ID NO: 10693 - DNA, 20 bp, Artificial Sequence
  Description of Artificial Sequence: Synthetic oligonucleotide
ttgagctgtggctgtgctgg

SEQ ID NO: 10694 - DNA, 20 bp, Artificial Sequence
  Description of Artificial Sequence: Synthetic oligonucleotide
tgagctgtggctgtgctggt

SEQ ID NO: 10695 - DNA, 20 bp, Artificial Sequence
  Description of Artificial Sequence: Synthetic oligonucleotide
gagctgtggctgtgctggtg

SEQ ID NO: 10696 - DNA, 20 bp, Artificial Sequence
  Description of Artificial Sequence: Synthetic oligonucleotide
agctgtggctgtgctggtgt

SEQ ID NO: 10697 - DNA, 20 bp, Artificial Sequence
  Description of Artificial Sequence: Synthetic oligonucleotide
gctgtggctgtgctggtgtc

SEQ ID NO: 10698 - DNA, 20 bp, Artificial Sequence
  Description of Artificial Sequence: Synthetic oligonucleotide
ctgtggctgtgctggtgtct

SEQ ID NO: 10699 - DNA, 20 bp, Artificial Sequence
  Description of Artificial Sequence: Synthetic oligonucleotide
tgtggctgtgctggtgtctt

SEQ ID NO: 10700 - DNA, 20 bp, Artificial Sequence
  Description of Artificial Sequence: Synthetic oligonucleotide
gtggctgtgctggtgtcttg

SEQ ID NO: 10701 - DNA, 20 bp, Artificial Sequence
  Description of Artificial Sequence: Synthetic oligonucleotide
tggctgtgctggtgtcttgt

SEQ ID NO: 10702 - DNA, 20 bp, Artificial Sequence
  Description of Artificial Sequence: Synthetic oligonucleotide
ggctgtgctggtgtcttgtg

SEQ ID NO: 10703 - DNA, 20 bp, Artificial Sequence
  Description of Artificial Sequence: Synthetic oligonucleotide
gctgtgctggtgtcttgtgc

SEQ ID NO: 10704 - DNA, 20 bp, Artificial Sequence
  Description of Artificial Sequence: Synthetic oligonucleotide
ctgtgctggtgtcttgtgct

SEQ ID NO: 10705 - DNA, 20 bp, Artificial Sequence
  Description of Artificial Sequence: Synthetic oligonucleotide
tgtgctggtgtcttgtgctt

SEQ ID NO: 10706 - DNA, 20 bp, Artificial Sequence
  Description of Artificial Sequence: Synthetic oligonucleotide
gtgctggtgtcttgtgctta

SEQ ID NO: 10707 - DNA, 20 bp, Artificial Sequence
  Description of Artificial Sequence: Synthetic oligonucleotide
tgctggtgtcttgtgcttag

SEQ ID NO: 10708 - DNA, 20 bp, Artificial Sequence
  Description of Artificial Sequence: Synthetic oligonucleotide
gctggtgtcttgtgcttaga

SEQ ID NO: 10709 - DNA, 20 bp, Artificial Sequence
  Description of Artificial Sequence: Synthetic oligonucleotide
ctggtgtcttgtgcttagag

SEQ ID NO: 10710 - DNA, 20 bp, Artificial Sequence
  Description of Artificial Sequence: Synthetic oligonucleotide
tggtgtcttgtgcttagaga

SEQ ID NO: 10711 - DNA, 20 bp, Artificial Sequence
  Description of Artificial Sequence: Synthetic oligonucleotide
ggtgtcttgtgcttagagag

SEQ ID NO: 10712 - DNA, 20 bp, Artificial Sequence
  Description of Artificial Sequence: Synthetic oligonucleotide
gtgtcttgtgcttagagagc

SEQ ID NO: 10713 - DNA, 20 bp, Artificial Sequence
  Description of Artificial Sequence: Synthetic oligonucleotide
tgtcttgtgcttagagagct

SEQ ID NO: 10714 - DNA, 20 bp, Artificial Sequence
  Description of Artificial Sequence: Synthetic oligonucleotide
gtcttgtgcttagagagctt

SEQ ID NO: 10715 - DNA, 20 bp, Artificial Sequence
  Description of Artificial Sequence: Synthetic oligonucleotide
tcttgtgcttagagagcttc

SEQ ID NO: 10716 - DNA, 20 bp, Artificial Sequence
  Description of Artificial Sequence: Synthetic oligonucleotide
cttgtgcttagagagcttct

SEQ ID NO: 10717 - DNA, 20 bp, Artificial Sequence
  Description of Artificial Sequence: Synthetic oligonucleotide
ttgtgcttagagagcttctg

SEQ ID NO: 10718 - DNA, 20 bp, Artificial Sequence
  Description of Artificial Sequence: Synthetic oligonucleotide
tgtgcttagagagcttctgc

SEQ ID NO: 10719 - DNA, 20 bp, Artificial Sequence
  Description of Artificial Sequence: Synthetic oligonucleotide
gtgcttagagagcttctgca

SEQ ID NO: 10720 - DNA, 20 bp, Artificial Sequence
  Description of Artificial Sequence: Synthetic oligonucleotide
tgcttagagagcttctgcag

SEQ ID NO: 10721 - DNA, 20 bp, Artificial Sequence
  Description of Artificial Sequence: Synthetic oligonucleotide
gcttagagagcttctgcagc

SEQ ID NO: 10722 - DNA, 20 bp, Artificial Sequence
  Description of Artificial Sequence: Synthetic oligonucleotide
cttagagagcttctgcagcc

SEQ ID NO: 10723 - DNA, 20 bp, Artificial Sequence
  Description of Artificial Sequence: Synthetic oligonucleotide
ttagagagcttctgcagcca

SEQ ID NO: 10724 - DNA, 20 bp, Artificial Sequence
  Description of Artificial Sequence: Synthetic oligonucleotide
tagagagcttctgcagccac

SEQ ID NO: 10725 - DNA, 20 bp, Artificial Sequence
  Description of Artificial Sequence: Synthetic oligonucleotide
agagagcttctgcagccacg

SEQ ID NO: 10726 - DNA, 20 bp, Artificial Sequence
  Description of Artificial Sequence: Synthetic oligonucleotide
gagagcttctgcagccacgc

SEQ ID NO: 10727 - DNA, 20 bp, Artificial Sequence
  Description of Artificial Sequence: Synthetic oligonucleotide
agagcttctgcagccacgct

SEQ ID NO: 10728 - DNA, 20 bp, Artificial Sequence
  Description of Artificial Sequence: Synthetic oligonucleotide
gagcttctgcagccacgctg

SEQ ID NO: 10729 - DNA, 20 bp, Artificial Sequence
  Description of Artificial Sequence: Synthetic oligonucleotide
agcttctgcagccacgctgg

SEQ ID NO: 10730 - DNA, 20 bp, Artificial Sequence
  Description of Artificial Sequence: Synthetic oligonucleotide
gcttctgcagccacgctggg

SEQ ID NO: 10731 - DNA, 20 bp, Artificial Sequence
  Description of Artificial Sequence: Synthetic oligonucleotide
cttctgcagccacgctgggt

SEQ ID NO: 10732 - DNA, 20 bp, Artificial Sequence
  Description of Artificial Sequence: Synthetic oligonucleotide
ttctgcagccacgctgggtg

SEQ ID NO: 10733 - DNA, 20 bp, Artificial Sequence
  Description of Artificial Sequence: Synthetic oligonucleotide
tctgcagccacgctgggtgg

SEQ ID NO: 10734 - DNA, 20 bp, Artificial Sequence
  Description of Artificial Sequence: Synthetic oligonucleotide
ctgcagccacgctgggtggc

SEQ ID NO: 10735 - DNA, 20 bp, Artificial Sequence
  Description of Artificial Sequence: Synthetic oligonucleotide
tgcagccacgctgggtggct

SEQ ID NO: 10736 - DNA, 20 bp, Artificial Sequence
  Description of Artificial Sequence: Synthetic oligonucleotide
gcagccacgctgggtggctg

SEQ ID NO: 10737 - DNA, 20 bp, Artificial Sequence
  Description of Artificial Sequence: Synthetic oligonucleotide
cagccacgctgggtggctga

SEQ ID NO: 10738 - DNA, 20 bp, Artificial Sequence
  Description of Artificial Sequence: Synthetic oligonucleotide
agccacgctgggtggctgac

SEQ ID NO: 10739 - DNA, 20 bp, Artificial Sequence
  Description of Artificial Sequence: Synthetic oligonucleotide
gccacgctgggtggctgaca

SEQ ID NO: 10740 - DNA, 20 bp, Artificial Sequence
  Description of Artificial Sequence: Synthetic oligonucleotide
ccacgctgggtggctgacaa

SEQ ID NO: 10741 - DNA, 20 bp, Artificial Sequence
  Description of Artificial Sequence: Synthetic oligonucleotide
cacgctgggtggctgacaaa

SEQ ID NO: 10742 - DNA, 20 bp, Artificial Sequence
  Description of Artificial Sequence: Synthetic oligonucleotide
acgctgggtggctgacaaag

SEQ ID NO: 10743 - DNA, 20 bp, Artificial Sequence
  Description of Artificial Sequence: Synthetic oligonucleotide
cgctgggtggctgacaaagg

SEQ ID NO: 10744 - DNA, 20 bp, Artificial Sequence
  Description of Artificial Sequence: Synthetic oligonucleotide
gctgggtggctgacaaaggc

SEQ ID NO: 10745 - DNA, 20 bp, Artificial Sequence
  Description of Artificial Sequence: Synthetic oligonucleotide
ctgggtggctgacaaaggcc

SEQ ID NO: 10746 - DNA, 20 bp, Artificial Sequence
  Description of Artificial Sequence: Synthetic oligonucleotide
tgggtggctgacaaaggcca

SEQ ID NO: 10747 - DNA, 20 bp, Artificial Sequence
  Description of Artificial Sequence: Synthetic oligonucleotide
gggtggctgacaaaggccac

SEQ ID NO: 10748 - DNA, 20 bp, Artificial Sequence
  Description of Artificial Sequence: Synthetic oligonucleotide
ggtggctgacaaaggccacg

SEQ ID NO: 10749 - DNA, 20 bp, Artificial Sequence
  Description of Artificial Sequence: Synthetic oligonucleotide
gtggctgacaaaggccacga

SEQ ID NO: 10750 - DNA, 20 bp, Artificial Sequence
  Description of Artificial Sequence: Synthetic oligonucleotide
tggctgacaaaggccacgat

SEQ ID NO: 10751 - DNA, 20 bp, Artificial Sequence
  Description of Artificial Sequence: Synthetic oligonucleotide
ggctgacaaaggccacgatg

SEQ ID NO: 10752 - DNA, 20 bp, Artificial Sequence
  Description of Artificial Sequence: Synthetic oligonucleotide
gctgacaaaggccacgatga

SEQ ID NO: 10753 - DNA, 20 bp, Artificial Sequence
  Description of Artificial Sequence: Synthetic oligonucleotide
ctgacaaaggccacgatgaa

SEQ ID NO: 10754 - DNA, 20 bp, Artificial Sequence
  Description of Artificial Sequence: Synthetic oligonucleotide
tgacaaaggccacgatgaaa

SEQ ID NO: 10755 - DNA, 20 bp, Artificial Sequence
  Description of Artificial Sequence: Synthetic oligonucleotide
gacaaaggccacgatgaaaa

SEQ ID NO: 10756 - DNA, 20 bp, Artificial Sequence
  Description of Artificial Sequence: Synthetic oligonucleotide
acaaaggccacgatgaaaat

SEQ ID NO: 10757 - DNA, 20 bp, Artificial Sequence
  Description of Artificial Sequence: Synthetic oligonucleotide
caaaggccacgatgaaaatg

SEQ ID NO: 10758 - DNA, 20 bp, Artificial Sequence
  Description of Artificial Sequence: Synthetic oligonucleotide
aaaggccacgatgaaaatgc

SEQ ID NO: 10759 - DNA, 20 bp, Artificial Sequence
  Description of Artificial Sequence: Synthetic oligonucleotide
aaggccacgatgaaaatgca

SEQ ID NO: 10760 - DNA, 20 bp, Artificial Sequence
  Description of Artificial Sequence: Synthetic oligonucleotide
aggccacgatgaaaatgcag

SEQ ID NO: 10761 - DNA, 20 bp, Artificial Sequence
  Description of Artificial Sequence: Synthetic oligonucleotide
ggccacgatgaaaatgcaga

SEQ ID NO: 10762 - DNA, 20 bp, Artificial Sequence
  Description of Artificial Sequence: Synthetic oligonucleotide
gccacgatgaaaatgcagag

SEQ ID NO: 10763 - DNA, 20 bp, Artificial Sequence
  Description of Artificial Sequence: Synthetic oligonucleotide
ccacgatgaaaatgcagagc

SEQ ID NO: 10764 - DNA, 20 bp, Artificial Sequence
  Description of Artificial Sequence: Synthetic oligonucleotide
cacgatgaaaatgcagagcc

SEQ ID NO: 10765 - DNA, 20 bp, Artificial Sequence
  Description of Artificial Sequence: Synthetic oligonucleotide
acgatgaaaatgcagagcca

SEQ ID NO: 10766 - DNA, 20 bp, Artificial Sequence
  Description of Artificial Sequence: Synthetic oligonucleotide
cgatgaaaatgcagagccag

SEQ ID NO: 10767 - DNA, 20 bp, Artificial Sequence
  Description of Artificial Sequence: Synthetic oligonucleotide
gatgaaaatgcagagccagg

SEQ ID NO: 10768 - DNA, 20 bp, Artificial Sequence
  Description of Artificial Sequence: Synthetic oligonucleotide
atgaaaatgcagagccaggt

SEQ ID NO: 10769 - DNA, 20 bp, Artificial Sequence
  Description of Artificial Sequence: Synthetic oligonucleotide
tgaaaatgcagagccaggtc

SEQ ID NO: 10770 - DNA, 20 bp, Artificial Sequence
  Description of Artificial Sequence: Synthetic oligonucleotide
gaaaatgcagagccaggtca

SEQ ID NO: 10771 - DNA, 20 bp, Artificial Sequence
  Description of Artificial Sequence: Synthetic oligonucleotide
aaaatgcagagccaggtcac

SEQ ID NO: 10772 - DNA, 20 bp, Artificial Sequence
  Description of Artificial Sequence: Synthetic oligonucleotide
aaatgcagagccaggtcaca

SEQ ID NO: 10773 - DNA, 20 bp, Artificial Sequence
  Description of Artificial Sequence: Synthetic oligonucleotide
aatgcagagccaggtcacag

SEQ ID NO: 10774 - DNA, 20 bp, Artificial Sequence
  Description of Artificial Sequence: Synthetic oligonucleotide
atgcagagccaggtcacagc

SEQ ID NO: 10775 - DNA, 20 bp, Artificial Sequence
  Description of Artificial Sequence: Synthetic oligonucleotide
tgcagagccaggtcacagct

SEQ ID NO: 10776 - DNA, 20 bp, Artificial Sequence
  Description of Artificial Sequence: Synthetic oligonucleotide
gcagagccaggtcacagctg

SEQ ID NO: 10777 - DNA, 20 bp, Artificial Sequence
  Description of Artificial Sequence: Synthetic oligonucleotide
cagagccaggtcacagctga

SEQ ID NO: 10778 - DNA, 20 bp, Artificial Sequence
  Description of Artificial Sequence: Synthetic oligonucleotide
agagccaggtcacagctgag

SEQ ID NO: 10779 - DNA, 20 bp, Artificial Sequence
  Description of Artificial Sequence: Synthetic oligonucleotide
gagccaggtcacagctgaga

SEQ ID NO: 10780 - DNA, 20 bp, Artificial Sequence
  Description of Artificial Sequence: Synthetic oligonucleotide
agccaggtcacagctgagag

SEQ ID NO: 10781 - DNA, 20 bp, Artificial Sequence
  Description of Artificial Sequence: Synthetic oligonucleotide
gccaggtcacagctgagaga

SEQ ID NO: 10782 - DNA, 20 bp, Artificial Sequence
  Description of Artificial Sequence: Synthetic oligonucleotide
ccaggtcacagctgagagag

SEQ ID NO: 10783 - DNA, 20 bp, Artificial Sequence
  Description of Artificial Sequence: Synthetic oligonucleotide
caggtcacagctgagagagg

SEQ ID NO: 10784 - DNA, 20 bp, Artificial Sequence
  Description of Artificial Sequence: Synthetic oligonucleotide
aggtcacagctgagagaggc

SEQ ID NO: 10785 - DNA, 20 bp, Artificial Sequence
  Description of Artificial Sequence: Synthetic oligonucleotide
ggtcacagctgagagaggct

SEQ ID NO: 10786 - DNA, 20 bp, Artificial Sequence
  Description of Artificial Sequence: Synthetic oligonucleotide
gtcacagctgagagaggctt

SEQ ID NO: 10787 - DNA, 20 bp, Artificial Sequence
  Description of Artificial Sequence: Synthetic oligonucleotide
tcacagctgagagaggcttt

SEQ ID NO: 10788 - DNA, 20 bp, Artificial Sequence
  Description of Artificial Sequence: Synthetic oligonucleotide
cacagctgagagaggctttt

SEQ ID NO: 10789 - DNA, 20 bp, Artificial Sequence
  Description of Artificial Sequence: Synthetic oligonucleotide
acagctgagagaggcttttt

SEQ ID NO: 10790 - DNA, 20 bp, Artificial Sequence
  Description of Artificial Sequence: Synthetic oligonucleotide
cagctgagagaggctttttc

SEQ ID NO: 10791 - DNA, 20 bp, Artificial Sequence
  Description of Artificial Sequence: Synthetic oligonucleotide
agctgagagaggctttttca

SEQ ID NO: 10792 - DNA, 20 bp, Artificial Sequence
  Description of Artificial Sequence: Synthetic oligonucleotide
gctgagagaggctttttcag

SEQ ID NO: 10793 - DNA, 20 bp, Artificial Sequence
  Description of Artificial Sequence: Synthetic oligonucleotide
ctgagagaggctttttcagc

SEQ ID NO: 10794 - DNA, 20 bp, Artificial Sequence
  Description of Artificial Sequence: Synthetic oligonucleotide
tgagagaggctttttcagca

SEQ ID NO: 10795 - DNA, 20 bp, Artificial Sequence
  Description of Artificial Sequence: Synthetic oligonucleotide
gagagaggctttttcagcat

SEQ ID NO: 10796 - DNA, 20 bp, Artificial Sequence
  Description of Artificial Sequence: Synthetic oligonucleotide
agagaggctttttcagcatc

SEQ ID NO: 10797 - DNA, 20 bp, Artificial Sequence
  Description of Artificial Sequence: Synthetic oligonucleotide
gagaggctttttcagcatct

SEQ ID NO: 10798 - DNA, 20 bp, Artificial Sequence
  Description of Artificial Sequence: Synthetic oligonucleotide
agaggctttttcagcatctt

SEQ ID NO: 10799 - DNA, 20 bp, Artificial Sequence
  Description of Artificial Sequence: Synthetic oligonucleotide
gaggctttttcagcatcttt

SEQ ID NO: 10800 - DNA, 20 bp, Artificial Sequence
  Description of Artificial Sequence: Synthetic oligonucleotide
aggctttttcagcatctttt

SEQ ID NO: 10801 - DNA, 20 bp, Artificial Sequence
  Description of Artificial Sequence: Synthetic oligonucleotide
ggctttttcagcatcttttg

SEQ ID NO: 10802 - DNA, 20 bp, Artificial Sequence
  Description of Artificial Sequence: Synthetic oligonucleotide
gctttttcagcatcttttgt

SEQ ID NO: 10803 - DNA, 20 bp, Artificial Sequence
  Description of Artificial Sequence: Synthetic oligonucleotide
ctttttcagcatcttttgtg

SEQ ID NO: 10804 - DNA, 20 bp, Artificial Sequence
  Description of Artificial Sequence: Synthetic oligonucleotide
tttttcagcatcttttgtgg

SEQ ID NO: 10805 - DNA, 20 bp, Artificial Sequence
  Description of Artificial Sequence: Synthetic oligonucleotide
ttttcagcatcttttgtggg

SEQ ID NO: 10806 - DNA, 20 bp, Artificial Sequence
  Description of Artificial Sequence: Synthetic oligonucleotide
tttcagcatcttttgtgggt

SEQ ID NO: 10807 - DNA, 20 bp, Artificial Sequence
  Description of Artificial Sequence: Synthetic oligonucleotide
ttcagcatcttttgtgggtt

SEQ ID NO: 10808 - DNA, 20 bp, Artificial Sequence
  Description of Artificial Sequence: Synthetic oligonucleotide
tcagcatcttttgtgggttt

SEQ ID NO: 10809 - DNA, 20 bp, Artificial Sequence
  Description of Artificial Sequence: Synthetic oligonucleotide
cagcatcttttgtgggtttg

SEQ ID NO: 10810 - DNA, 20 bp, Artificial Sequence
  Description of Artificial Sequence: Synthetic oligonucleotide
agcatcttttgtgggtttgg

SEQ ID NO: 10811 - DNA, 20 bp, Artificial Sequence
  Description of Artificial Sequence: Synthetic oligonucleotide
gcatcttttgtgggtttggg

SEQ ID NO: 10812 - DNA, 20 bp, Artificial Sequence
  Description of Artificial Sequence: Synthetic oligonucleotide
catcttttgtgggtttgggt

SEQ ID NO: 10813 - DNA, 20 bp, Artificial Sequence
  Description of Artificial Sequence: Synthetic oligonucleotide
atcttttgtgggtttgggtg

SEQ ID NO: 10814 - DNA, 20 bp, Artificial Sequence
  Description of Artificial Sequence: Synthetic oligonucleotide
tcttttgtgggtttgggtga

SEQ ID NO: 10815 - DNA, 20 bp, Artificial Sequence
  Description of Artificial Sequence: Synthetic oligonucleotide
cttttgtgggtttgggtgag

SEQ ID NO: 10816 - DNA, 20 bp, Artificial Sequence
  Description of Artificial Sequence: Synthetic oligonucleotide
ttttgtgggtttgggtgagg

SEQ ID NO: 10817 - DNA, 20 bp, Artificial Sequence
  Description of Artificial Sequence: Synthetic oligonucleotide
tttgtgggtttgggtgagga

SEQ ID NO: 10818 - DNA, 20 bp, Artificial Sequence
  Description of Artificial Sequence: Synthetic oligonucleotide
ttgtgggtttgggtgaggaa

SEQ ID NO: 10819 - DNA, 20 bp, Artificial Sequence
  Description of Artificial Sequence: Synthetic oligonucleotide
tgtgggtttgggtgaggaag

SEQ ID NO: 10820 - DNA, 20 bp, Artificial Sequence
  Description of Artificial Sequence: Synthetic oligonucleotide
gtgggtttgggtgaggaagg

SEQ ID NO: 10821 - DNA, 20 bp, Artificial Sequence
  Description of Artificial Sequence: Synthetic oligonucleotide
tgggtttgggtgaggaaggc

SEQ ID NO: 10822 - DNA, 20 bp, Artificial Sequence
  Description of Artificial Sequence: Synthetic oligonucleotide
gggtttgggtgaggaaggct

SEQ ID NO: 10823 - DNA, 20 bp, Artificial Sequence
  Description of Artificial Sequence: Synthetic oligonucleotide
ggtttgggtgaggaaggctc

SEQ ID NO: 10824 - DNA, 20 bp, Artificial Sequence
  Description of Artificial Sequence: Synthetic oligonucleotide
gtttgggtgaggaaggctct

SEQ ID NO: 10825 - DNA, 20 bp, Artificial Sequence
  Description of Artificial Sequence: Synthetic oligonucleotide
tttgggtgaggaaggctctt

SEQ ID NO: 10826 - DNA, 20 bp, Artificial Sequence
  Description of Artificial Sequence: Synthetic oligonucleotide
ttgggtgaggaaggctcttc

SEQ ID NO: 10827 - DNA, 20 bp, Artificial Sequence
  Description of Artificial Sequence: Synthetic oligonucleotide
tgggtgaggaaggctcttcc

SEQ ID NO: 10828 - DNA, 20 bp, Artificial Sequence
  Description of Artificial Sequence: Synthetic oligonucleotide
gggtgaggaaggctcttcct

SEQ ID NO: 10829 - DNA, 20 bp, Artificial Sequence
  Description of Artificial Sequence: Synthetic oligonucleotide
ggtgaggaaggctcttcctt

SEQ ID NO: 10830 - DNA, 20 bp, Artificial Sequence
  Description of Artificial Sequence: Synthetic oligonucleotide
gtgaggaaggctcttccttc

SEQ ID NO: 10831 - DNA, 20 bp, Artificial Sequence
  Description of Artificial Sequence: Synthetic oligonucleotide
tgaggaaggctcttccttca

SEQ ID NO: 10832 - DNA, 20 bp, Artificial Sequence
  Description of Artificial Sequence: Synthetic oligonucleotide
gaggaaggctcttccttcag

SEQ ID NO: 10833 - DNA, 20 bp, Artificial Sequence
  Description of Artificial Sequence: Synthetic oligonucleotide
aggaaggctcttccttcagg

SEQ ID NO: 10834 - DNA, 20 bp, Artificial Sequence
  Description of Artificial Sequence: Synthetic oligonucleotide
ggaaggctcttccttcaggg

SEQ ID NO: 10835 - DNA, 20 bp, Artificial Sequence
  Description of Artificial Sequence: Synthetic oligonucleotide
gaaggctcttccttcagggg

SEQ ID NO: 10836 - DNA, 20 bp, Artificial Sequence
  Description of Artificial Sequence: Synthetic oligonucleotide
aaggctcttccttcagggga

SEQ ID NO: 10837 - DNA, 20 bp, Artificial Sequence
  Description of Artificial Sequence: Synthetic oligonucleotide
aggctcttccttcaggggag

SEQ ID NO: 10838 - DNA, 20 bp, Artificial Sequence
  Description of Artificial Sequence: Synthetic oligonucleotide
ggctcttccttcaggggagt

SEQ ID NO: 10839 - DNA, 20 bp, Artificial Sequence
  Description of Artificial Sequence: Synthetic oligonucleotide
gctcttccttcaggggagtc

SEQ ID NO: 10840 - DNA, 20 bp, Artificial Sequence
  Description of Artificial Sequence: Synthetic oligonucleotide
ctcttccttcaggggagtct

SEQ ID NO: 10841 - DNA, 20 bp, Artificial Sequence
  Description of Artificial Sequence: Synthetic oligonucleotide
tcttccttcaggggagtctg

SEQ ID NO: 10842 - DNA, 20 bp, Artificial Sequence
  Description of Artificial Sequence: Synthetic oligonucleotide
cttccttcaggggagtctgg

SEQ ID NO: 10843 - DNA, 20 bp, Artificial Sequence
  Description of Artificial Sequence: Synthetic oligonucleotide
ttccttcaggggagtctgga

SEQ ID NO: 10844 - DNA, 20 bp, Artificial Sequence
  Description of Artificial Sequence: Synthetic oligonucleotide
tccttcaggggagtctggag

SEQ ID NO: 10845 - DNA, 20 bp, Artificial Sequence
  Description of Artificial Sequence: Synthetic oligonucleotide
ccttcaggggagtctggaga

SEQ ID NO: 10846 - DNA, 20 bp, Artificial Sequence
  Description of Artificial Sequence: Synthetic oligonucleotide
cttcaggggagtctggagat

SEQ ID NO: 10847 - DNA, 20 bp, Artificial Sequence
  Description of Artificial Sequence: Synthetic oligonucleotide
ttcaggggagtctggagatg

SEQ ID NO: 10848 - DNA, 20 bp, Artificial Sequence
  Description of Artificial Sequence: Synthetic oligonucleotide
tcaggggagtctggagatgc

SEQ ID NO: 10849 - DNA, 20 bp, Artificial Sequence
  Description of Artificial Sequence: Synthetic oligonucleotide
caggggagtctggagatgcc

SEQ ID NO: 10850 - DNA, 20 bp, Artificial Sequence
  Description of Artificial Sequence: Synthetic oligonucleotide
aggggagtctggagatgccc

SEQ ID NO: 10851 - DNA, 20 bp, Artificial Sequence
  Description of Artificial Sequence: Synthetic oligonucleotide
ggggagtctggagatgccca

SEQ ID NO: 10852 - DNA, 20 bp, Artificial Sequence
  Description of Artificial Sequence: Synthetic oligonucleotide
gggagtctggagatgcccag

SEQ ID NO: 10853 - DNA, 20 bp, Artificial Sequence
  Description of Artificial Sequence: Synthetic oligonucleotide
ggagtctggagatgcccagc

SEQ ID NO: 10854 - DNA, 20 bp, Artificial Sequence
  Description of Artificial Sequence: Synthetic oligonucleotide
gagtctggagatgcccagct

SEQ ID NO: 10855 - DNA, 20 bp, Artificial Sequence
  Description of Artificial Sequence: Synthetic oligonucleotide
agtctggagatgcccagctg

SEQ ID NO: 10856 - DNA, 20 bp, Artificial Sequence
  Description of Artificial Sequence: Synthetic oligonucleotide
gtctggagatgcccagctga

SEQ ID NO: 10857 - DNA, 20 bp, Artificial Sequence
  Description of Artificial Sequence: Synthetic oligonucleotide
tctggagatgcccagctgag

SEQ ID NO: 10858 - DNA, 20 bp, Artificial Sequence
  Description of Artificial Sequence: Synthetic oligonucleotide
ctggagatgcccagctgagg

SEQ ID NO: 10859 - DNA, 20 bp, Artificial Sequence
  Description of Artificial Sequence: Synthetic oligonucleotide
tggagatgcccagctgaggt

SEQ ID NO: 10860 - DNA, 20 bp, Artificial Sequence
  Description of Artificial Sequence: Synthetic oligonucleotide
ggagatgcccagctgaggtc

SEQ ID NO: 10861 - DNA, 20 bp, Artificial Sequence
  Description of Artificial Sequence: Synthetic oligonucleotide
gagatgcccagctgaggtct

SEQ ID NO: 10862 - DNA, 20 bp, Artificial Sequence
  Description of Artificial Sequence: Synthetic oligonucleotide
agatgcccagctgaggtctg

SEQ ID NO: 10863 - DNA, 20 bp, Artificial Sequence
  Description of Artificial Sequence: Synthetic oligonucleotide
gatgcccagctgaggtctgc

SEQ ID NO: 10864 - DNA, 20 bp, Artificial Sequence
  Description of Artificial Sequence: Synthetic oligonucleotide
atgcccagctgaggtctgca

SEQ ID NO: 10865 - DNA, 20 bp, Artificial Sequence
  Description of Artificial Sequence: Synthetic oligonucleotide
tgcccagctgaggtctgcaa

SEQ ID NO: 10866 - DNA, 20 bp, Artificial Sequence
  Description of Artificial Sequence: Synthetic oligonucleotide
gcccagctgaggtctgcaaa

SEQ ID NO: 10867 - DNA, 20 bp, Artificial Sequence
  Description of Artificial Sequence: Synthetic oligonucleotide
cccagctgaggtctgcaaag

SEQ ID NO: 10868 - DNA, 20 bp, Artificial Sequence
  Description of Artificial Sequence: Synthetic oligonucleotide
ccagctgaggtctgcaaagc

SEQ ID NO: 10869 - DNA, 20 bp, Artificial Sequence
  Description of Artificial Sequence: Synthetic oligonucleotide
cagctgaggtctgcaaagct

SEQ ID NO: 10870 - DNA, 20 bp, Artificial Sequence
  Description of Artificial Sequence: Synthetic oligonucleotide
agctgaggtctgcaaagctg

SEQ ID NO: 10871 - DNA, 20 bp, Artificial Sequence
  Description of Artificial Sequence: Synthetic oligonucleotide
gctgaggtctgcaaagctgc

SEQ ID NO: 10872 - DNA, 20 bp, Artificial Sequence
  Description of Artificial Sequence: Synthetic oligonucleotide
ctgaggtctgcaaagctgca

SEQ ID NO: 10873 - DNA, 20 bp, Artificial Sequence
  Description of Artificial Sequence: Synthetic oligonucleotide
tgaggtctgcaaagctgcag

SEQ ID NO: 10874 - DNA, 20 bp, Artificial Sequence
  Description of Artificial Sequence: Synthetic oligonucleotide
gaggtctgcaaagctgcagc

SEQ ID NO: 10875 - DNA, 20 bp, Artificial Sequence
  Description of Artificial Sequence: Synthetic oligonucleotide
aggtctgcaaagctgcagca

SEQ ID NO: 10876 - DNA, 20 bp, Artificial Sequence
  Description of Artificial Sequence: Synthetic oligonucleotide
ggtctgcaaagctgcagcag

SEQ ID NO: 10877 - DNA, 20 bp, Artificial Sequence
  Description of Artificial Sequence: Synthetic oligonucleotide
gtctgcaaagctgcagcagg

SEQ ID NO: 10878 - DNA, 20 bp, Artificial Sequence
  Description of Artificial Sequence: Synthetic oligonucleotide
tctgcaaagctgcagcaggc

SEQ ID NO: 10879 - DNA, 20 bp, Artificial Sequence
  Description of Artificial Sequence: Synthetic oligonucleotide
ctgcaaagctgcagcaggct

SEQ ID NO: 10880 - DNA, 20 bp, Artificial Sequence
  Description of Artificial Sequence: Synthetic oligonucleotide
tgcaaagctgcagcaggctg

SEQ ID NO: 10881 - DNA, 20 bp, Artificial Sequence
  Description of Artificial Sequence: Synthetic oligonucleotide
gcaaagctgcagcaggctga

SEQ ID NO: 10882 - DNA, 20 bp, Artificial Sequence
  Description of Artificial Sequence: Synthetic oligonucleotide
caaagctgcagcaggctgac

SEQ ID NO: 10883 - DNA, 20 bp, Artificial Sequence
  Description of Artificial Sequence: Synthetic oligonucleotide
aaagctgcagcaggctgact

SEQ ID NO: 10884 - DNA, 20 bp, Artificial Sequence
  Description of Artificial Sequence: Synthetic oligonucleotide
aagctgcagcaggctgactg

SEQ ID NO: 10885 - DNA, 20 bp, Artificial Sequence
  Description of Artificial Sequence: Synthetic oligonucleotide
agctgcagcaggctgactga

SEQ ID NO: 10886 - DNA, 20 bp, Artificial Sequence
  Description of Artificial Sequence: Synthetic oligonucleotide
gctgcagcaggctgactgaa

SEQ ID NO: 10887 - DNA, 20 bp, Artificial Sequence
  Description of Artificial Sequence: Synthetic oligonucleotide
ctgcagcaggctgactgaac

SEQ ID NO: 10888 - DNA, 20 bp, Artificial Sequence
  Description of Artificial Sequence: Synthetic oligonucleotide
tgcagcaggctgactgaacc

SEQ ID NO: 10889 - DNA, 20 bp, Artificial Sequence
  Description of Artificial Sequence: Synthetic oligonucleotide
gcagcaggctgactgaacct

SEQ ID NO: 10890 - DNA, 20 bp, Artificial Sequence
  Description of Artificial Sequence: Synthetic oligonucleotide
cagcaggctgactgaacctt

SEQ ID NO: 10891 - DNA, 20 bp, Artificial Sequence
  Description of Artificial Sequence: Synthetic oligonucleotide
agcaggctgactgaacctta

SEQ ID NO: 10892 - DNA, 20 bp, Artificial Sequence
  Description of Artificial Sequence: Synthetic oligonucleotide
gcaggctgactgaaccttac

SEQ ID NO: 10893 - DNA, 20 bp, Artificial Sequence
  Description of Artificial Sequence: Synthetic oligonucleotide
caggctgactgaaccttacg

SEQ ID NO: 10894 - DNA, 20 bp, Artificial Sequence
  Description of Artificial Sequence: Synthetic oligonucleotide
aggctgactgaaccttacgc

SEQ ID NO: 10895 - DNA, 20 bp, Artificial Sequence
  Description of Artificial Sequence: Synthetic oligonucleotide
ggctgactgaaccttacgct

SEQ ID NO: 10896 - DNA, 20 bp, Artificial Sequence
  Description of Artificial Sequence: Synthetic oligonucleotide
gctgactgaaccttacgctt

SEQ ID NO: 10897 - DNA, 20 bp, Artificial Sequence
  Description of Artificial Sequence: Synthetic oligonucleotide
ctgactgaaccttacgcttt

SEQ ID NO: 10898 - DNA, 20 bp, Artificial Sequence
  Description of Artificial Sequence: Synthetic oligonucleotide
tgactgaaccttacgctttc

SEQ ID NO: 10899 - DNA, 20 bp, Artificial Sequence
  Description of Artificial Sequence: Synthetic oligonucleotide
gactgaaccttacgctttca

SEQ ID NO: 10900 - DNA, 20 bp, Artificial Sequence
  Description of Artificial Sequence: Synthetic oligonucleotide
actgaaccttacgctttcac

SEQ ID NO: 10901 - DNA, 20 bp, Artificial Sequence
  Description of Artificial Sequence: Synthetic oligonucleotide
ctgaaccttacgctttcact

SEQ ID NO: 10902 - DNA, 20 bp, Artificial Sequence
  Description of Artificial Sequence: Synthetic oligonucleotide
tgaaccttacgctttcactc

SEQ ID NO: 10903 - DNA, 20 bp, Artificial Sequence
  Description of Artificial Sequence: Synthetic oligonucleotide
gaaccttacgctttcactct

SEQ ID NO: 10904 - DNA, 20 bp, Artificial Sequence
  Description of Artificial Sequence: Synthetic oligonucleotide
aaccttacgctttcactctg

SEQ ID NO: 10905 - DNA, 20 bp, Artificial Sequence
  Description of Artificial Sequence: Synthetic oligonucleotide
accttacgctttcactctga

SEQ ID NO: 10906 - DNA, 20 bp, Artificial Sequence
  Description of Artificial Sequence: Synthetic oligonucleotide
ccttacgctttcactctgag

SEQ ID NO: 10907 - DNA, 20 bp, Artificial Sequence
  Description of Artificial Sequence: Synthetic oligonucleotide
cttacgctttcactctgagg

SEQ ID NO: 10908 - DNA, 20 bp, Artificial Sequence
  Description of Artificial Sequence: Synthetic oligonucleotide
ttacgctttcactctgaggg

SEQ ID NO: 10909 - DNA, 20 bp, Artificial Sequence
  Description of Artificial Sequence: Synthetic oligonucleotide
tacgctttcactctgagggc

SEQ ID NO: 10910 - DNA, 20 bp, Artificial Sequence
  Description of Artificial Sequence: Synthetic oligonucleotide
acgctttcactctgagggcc

SEQ ID NO: 10911 - DNA, 20 bp, Artificial Sequence
  Description of Artificial Sequence: Synthetic oligonucleotide
cgctttcactctgagggcct

SEQ ID NO: 10912 - DNA, 20 bp, Artificial Sequence
  Description of Artificial Sequence: Synthetic oligonucleotide
gctttcactctgagggcctc

SEQ ID NO: 10913 - DNA, 20 bp, Artificial Sequence
  Description of Artificial Sequence: Synthetic oligonucleotide
ctttcactctgagggcctcg

SEQ ID NO: 10914 - DNA, 20 bp, Artificial Sequence
  Description of Artificial Sequence: Synthetic oligonucleotide
tttcactctgagggcctcgc

SEQ ID NO: 10915 - DNA, 20 bp, Artificial Sequence
  Description of Artificial Sequence: Synthetic oligonucleotide
ttcactctgagggcctcgcc

SEQ ID NO: 10916 - DNA, 20 bp, Artificial Sequence
  Description of Artificial Sequence: Synthetic oligonucleotide
tcactctgagggcctcgcca

SEQ ID NO: 10917 - DNA, 20 bp, Artificial Sequence
  Description of Artificial Sequence: Synthetic oligonucleotide
cactctgagggcctcgccac

SEQ ID NO: 10918 - DNA, 20 bp, Artificial Sequence
  Description of Artificial Sequence: Synthetic oligonucleotide
actctgagggcctcgccact

SEQ ID NO: 10919 - DNA, 20 bp, Artificial Sequence
  Description of Artificial Sequence: Synthetic oligonucleotide
ctctgagggcctcgccactt

SEQ ID NO: 10920 - DNA, 20 bp, Artificial Sequence
  Description of Artificial Sequence: Synthetic oligonucleotide
tctgagggcctcgccacttt

SEQ ID NO: 10921 - DNA, 20 bp, Artificial Sequence
  Description of Artificial Sequence: Synthetic oligonucleotide
ctgagggcctcgccactttg

SEQ ID NO: 10922 - DNA, 20 bp, Artificial Sequence
  Description of Artificial Sequence: Synthetic oligonucleotide
tgagggcctcgccactttgt

SEQ ID NO: 10923 - DNA, 20 bp, Artificial Sequence
  Description of Artificial Sequence: Synthetic oligonucleotide
gagggcctcgccactttgtt

SEQ ID NO: 10924 - DNA, 20 bp, Artificial Sequence
  Description of Artificial Sequence: Synthetic oligonucleotide
agggcctcgccactttgttg

SEQ ID NO: 10925 - DNA, 20 bp, Artificial Sequence
  Description of Artificial Sequence: Synthetic oligonucleotide
gggcctcgccactttgttgt

SEQ ID NO: 10926 - DNA, 20 bp, Artificial Sequence
  Description of Artificial Sequence: Synthetic oligonucleotide
ggcctcgccactttgttgtt

SEQ ID NO: 10927 - DNA, 20 bp, Artificial Sequence
  Description of Artificial Sequence: Synthetic oligonucleotide
gcctcgccactttgttgttt

SEQ ID NO: 10928 - DNA, 20 bp, Artificial Sequence
  Description of Artificial Sequence: Synthetic oligonucleotide
cctcgccactttgttgtttt

SEQ ID NO: 10929 - DNA, 20 bp, Artificial Sequence
  Description of Artificial Sequence: Synthetic oligonucleotide
ctcgccactttgttgttttc

SEQ ID NO: 10930 - DNA, 20 bp, Artificial Sequence
  Description of Artificial Sequence: Synthetic oligonucleotide
tcgccactttgttgttttct

SEQ ID NO: 10931 - DNA, 20 bp, Artificial Sequence
  Description of Artificial Sequence: Synthetic oligonucleotide
cgccactttgttgttttctc

SEQ ID NO: 10932 - DNA, 20 bp, Artificial Sequence
  Description of Artificial Sequence: Synthetic oligonucleotide
gccactttgttgttttctct

SEQ ID NO: 10933 - DNA, 20 bp, Artificial Sequence
  Description of Artificial Sequence: Synthetic oligonucleotide
ccactttgttgttttctctc

SEQ ID NO: 10934 - DNA, 20 bp, Artificial Sequence
  Description of Artificial Sequence: Synthetic oligonucleotide
cactttgttgttttctctct

SEQ ID NO: 10935 - DNA, 20 bp, Artificial Sequence
  Description of Artificial Sequence: Synthetic oligonucleotide
actttgttgttttctctctt

SEQ ID NO: 10936 - DNA, 20 bp, Artificial Sequence
  Description of Artificial Sequence: Synthetic oligonucleotide
ctttgttgttttctctcttt

SEQ ID NO: 10937 - DNA, 20 bp, Artificial Sequence
  Description of Artificial Sequence: Synthetic oligonucleotide
tttgttgttttctctctttc

SEQ ID NO: 10938 - DNA, 20 bp, Artificial Sequence
  Description of Artificial Sequence: Synthetic oligonucleotide
ttgttgttttctctctttcc

SEQ ID NO: 10939 - DNA, 20 bp, Artificial Sequence
  Description of Artificial Sequence: Synthetic oligonucleotide
tgttgttttctctctttcct

SEQ ID NO: 10940 - DNA, 20 bp, Artificial Sequence
  Description of Artificial Sequence: Synthetic oligonucleotide
gttgttttctctctttcctt

SEQ ID NO: 10941 - DNA, 20 bp, Artificial Sequence
  Description of Artificial Sequence: Synthetic oligonucleotide
ttgttttctctctttccttg

SEQ ID NO: 10942 - DNA, 20 bp, Artificial Sequence
  Description of Artificial Sequence: Synthetic oligonucleotide
tgttttctctctttccttgc

SEQ ID NO: 10943 - DNA, 20 bp, Artificial Sequence
  Description of Artificial Sequence: Synthetic oligonucleotide
gttttctctctttccttgct

SEQ ID NO: 10944 - DNA, 20 bp, Artificial Sequence
  Description of Artificial Sequence: Synthetic oligonucleotide
ttttctctctttccttgctc

SEQ ID NO: 10945 - DNA, 20 bp, Artificial Sequence
  Description of Artificial Sequence: Synthetic oligonucleotide
tttctctctttccttgctct

SEQ ID NO: 10946 - DNA, 20 bp, Artificial Sequence
  Description of Artificial Sequence: Synthetic oligonucleotide
ttctctctttccttgctctt

SEQ ID NO: 10947 - DNA, 20 bp, Artificial Sequence
  Description of Artificial Sequence: Synthetic oligonucleotide
tctctctttccttgctcttt

SEQ ID NO: 10948 - DNA, 20 bp, Artificial Sequence
  Description of Artificial Sequence: Synthetic oligonucleotide
ctctctttccttgctctttg

SEQ ID NO: 10949 - DNA, 20 bp, Artificial Sequence
  Description of Artificial Sequence: Synthetic oligonucleotide
tctctttccttgctctttgc

SEQ ID NO: 10950 - DNA, 20 bp, Artificial Sequence
  Description of Artificial Sequence: Synthetic oligonucleotide
ctctttccttgctctttgct

SEQ ID NO: 10951 - DNA, 20 bp, Artificial Sequence
  Description of Artificial Sequence: Synthetic oligonucleotide
tctttccttgctctttgcta

SEQ ID NO: 10952 - DNA, 20 bp, Artificial Sequence
  Description of Artificial Sequence: Synthetic oligonucleotide
ctttccttgctctttgctag

SEQ ID NO: 10953 - DNA, 20 bp, Artificial Sequence
  Description of Artificial Sequence: Synthetic oligonucleotide
tttccttgctctttgctagc

SEQ ID NO: 10954 - DNA, 20 bp, Artificial Sequence
  Description of Artificial Sequence: Synthetic oligonucleotide
ttccttgctctttgctagcc

SEQ ID NO: 10955 - DNA, 20 bp, Artificial Sequence
  Description of Artificial Sequence: Synthetic oligonucleotide
tccttgctctttgctagcct

SEQ ID NO: 10956 - DNA, 20 bp, Artificial Sequence
  Description of Artificial Sequence: Synthetic oligonucleotide
ccttgctctttgctagcctt

SEQ ID NO: 10957 - DNA, 20 bp, Artificial Sequence
  Description of Artificial Sequence: Synthetic oligonucleotide
cttgctctttgctagccttt

SEQ ID NO: 10958 - DNA, 20 bp, Artificial Sequence
  Description of Artificial Sequence: Synthetic oligonucleotide
ttgctctttgctagcctttc

SEQ ID NO: 10959 - DNA, 20 bp, Artificial Sequence
  Description of Artificial Sequence: Synthetic oligonucleotide
tgctctttgctagcctttct

SEQ ID NO: 10960 - DNA, 20 bp, Artificial Sequence
  Description of Artificial Sequence: Synthetic oligonucleotide
gctctttgctagcctttctc

SEQ ID NO: 10961 - DNA, 20 bp, Artificial Sequence
  Description of Artificial Sequence: Synthetic oligonucleotide
ctctttgctagcctttctca

SEQ ID NO: 10962 - DNA, 20 bp, Artificial Sequence
  Description of Artificial Sequence: Synthetic oligonucleotide
tctttgctagcctttctcaa

SEQ ID NO: 10963 - DNA, 20 bp, Artificial Sequence
  Description of Artificial Sequence: Synthetic oligonucleotide
ctttgctagcctttctcaaa

SEQ ID NO: 10964 - DNA, 20 bp, Artificial Sequence
  Description of Artificial Sequence: Synthetic oligonucleotide
tttgctagcctttctcaaag

SEQ ID NO: 10965 - DNA, 20 bp, Artificial Sequence
  Description of Artificial Sequence: Synthetic oligonucleotide
ttgctagcctttctcaaagc

SEQ ID NO: 10966 - DNA, 20 bp, Artificial Sequence
  Description of Artificial Sequence: Synthetic oligonucleotide
tgctagcctttctcaaagct

SEQ ID NO: 10967 - DNA, 20 bp, Artificial Sequence
  Description of Artificial Sequence: Synthetic oligonucleotide
gctagcctttctcaaagctt

SEQ ID NO: 10968 - DNA, 20 bp, Artificial Sequence
  Description of Artificial Sequence: Synthetic oligonucleotide
ctagcctttctcaaagcttg

SEQ ID NO: 10969 - DNA, 20 bp, Artificial Sequence
  Description of Artificial Sequence: Synthetic oligonucleotide
tagcctttctcaaagcttga

SEQ ID NO: 10970 - DNA, 20 bp, Artificial Sequence
  Description of Artificial Sequence: Synthetic oligonucleotide
agcctttctcaaagcttgag

SEQ ID NO: 10971 - DNA, 20 bp, Artificial Sequence
  Description of Artificial Sequence: Synthetic oligonucleotide
gcctttctcaaagcttgagt

SEQ ID NO: 10972 - DNA, 20 bp, Artificial Sequence
  Description of Artificial Sequence: Synthetic oligonucleotide
cctttctcaaagcttgagtc

SEQ ID NO: 10973 - DNA, 20 bp, Artificial Sequence
  Description of Artificial Sequence: Synthetic oligonucleotide
ctttctcaaagcttgagtct

SEQ ID NO: 10974 - DNA, 20 bp, Artificial Sequence
  Description of Artificial Sequence: Synthetic oligonucleotide
tttctcaaagcttgagtctc

SEQ ID NO: 10975 - DNA, 20 bp, Artificial Sequence
  Description of Artificial Sequence: Synthetic oligonucleotide
ttctcaaagcttgagtctct

SEQ ID NO: 10976 - DNA, 20 bp, Artificial Sequence
  Description of Artificial Sequence: Synthetic oligonucleotide
tctcaaagcttgagtctctg

SEQ ID NO: 10977 - DNA, 20 bp, Artificial Sequence
  Description of Artificial Sequence: Synthetic oligonucleotide
ctcaaagcttgagtctctga

SEQ ID NO: 10978 - DNA, 20 bp, Artificial Sequence
  Description of Artificial Sequence: Synthetic oligonucleotide
tcaaagcttgagtctctgac

SEQ ID NO: 10979 - DNA, 20 bp, Artificial Sequence
  Description of Artificial Sequence: Synthetic oligonucleotide
caaagcttgagtctctgaca

SEQ ID NO: 10980 - DNA, 20 bp, Artificial Sequence
  Description of Artificial Sequence: Synthetic oligonucleotide
aaagcttgagtctctgacag

SEQ ID NO: 10981 - DNA, 20 bp, Artificial Sequence
  Description of Artificial Sequence: Synthetic oligonucleotide
aagcttgagtctctgacagg

SEQ ID NO: 10982 - DNA, 20 bp, Artificial Sequence
  Description of Artificial Sequence: Synthetic oligonucleotide
agcttgagtctctgacaggg

SEQ ID NO: 10983 - DNA, 20 bp, Artificial Sequence
  Description of Artificial Sequence: Synthetic oligonucleotide
gcttgagtctctgacagggg

SEQ ID NO: 10984 - DNA, 20 bp, Artificial Sequence
  Description of Artificial Sequence: Synthetic oligonucleotide
cttgagtctctgacagggga

SEQ ID NO: 10985 - DNA, 20 bp, Artificial Sequence
  Description of Artificial Sequence: Synthetic oligonucleotide
ttgagtctctgacaggggag

SEQ ID NO: 10986 - DNA, 20 bp, Artificial Sequence
  Description of Artificial Sequence: Synthetic oligonucleotide
tgagtctctgacaggggagc

SEQ ID NO: 10987 - DNA, 20 bp, Artificial Sequence
  Description of Artificial Sequence: Synthetic oligonucleotide
gagtctctgacaggggagct

SEQ ID NO: 10988 - DNA, 20 bp, Artificial Sequence
  Description of Artificial Sequence: Synthetic oligonucleotide
agtctctgacaggggagctg

SEQ ID NO: 10989 - DNA, 20 bp, Artificial Sequence
  Description of Artificial Sequence: Synthetic oligonucleotide
gtctctgacaggggagctga

SEQ ID NO: 10990 - DNA, 20 bp, Artificial Sequence
  Description of Artificial Sequence: Synthetic oligonucleotide
tctctgacaggggagctgaa

SEQ ID NO: 10991 - DNA, 20 bp, Artificial Sequence
  Description of Artificial Sequence: Synthetic oligonucleotide
ctctgacaggggagctgaat

SEQ ID NO: 10992 - DNA, 20 bp, Artificial Sequence
  Description of Artificial Sequence: Synthetic oligonucleotide
tctgacaggggagctgaatg

SEQ ID NO: 10993 - DNA, 20 bp, Artificial Sequence
  Description of Artificial Sequence: Synthetic oligonucleotide
ctgacaggggagctgaatgg

SEQ ID NO: 10994 - DNA, 20 bp, Artificial Sequence
  Description of Artificial Sequence: Synthetic oligonucleotide
tgacaggggagctgaatggg

SEQ ID NO: 10995 - DNA, 20 bp, Artificial Sequence
  Description of Artificial Sequence: Synthetic oligonucleotide
gacaggggagctgaatgggt

SEQ ID NO: 10996 - DNA, 20 bp, Artificial Sequence
  Description of Artificial Sequence: Synthetic oligonucleotide
acaggggagctgaatgggta

SEQ ID NO: 10997 - DNA, 20 bp, Artificial Sequence
  Description of Artificial Sequence: Synthetic oligonucleotide
caggggagctgaatgggtag

SEQ ID NO: 10998 - DNA, 20 bp, Artificial Sequence
  Description of Artificial Sequence: Synthetic oligonucleotide
aggggagctgaatgggtagc

SEQ ID NO: 10999 - DNA, 20 bp, Artificial Sequence
  Description of Artificial Sequence: Synthetic oligonucleotide
ggggagctgaatgggtagcc

SEQ ID NO: 11000 - DNA, 20 bp, Artificial Sequence
  Description of Artificial Sequence: Synthetic oligonucleotide
gggagctgaatgggtagcct

SEQ ID NO: 11001 - DNA, 20 bp, Artificial Sequence
  Description of Artificial Sequence: Synthetic oligonucleotide
ggagctgaatgggtagccta

SEQ ID NO: 11002 - DNA, 20 bp, Artificial Sequence
  Description of Artificial Sequence: Synthetic oligonucleotide
gagctgaatgggtagcctat

SEQ ID NO: 11003 - DNA, 20 bp, Artificial Sequence
  Description of Artificial Sequence: Synthetic oligonucleotide
agctgaatgggtagcctata

SEQ ID NO: 11004 - DNA, 20 bp, Artificial Sequence
  Description of Artificial Sequence: Synthetic oligonucleotide
gctgaatgggtagcctatag

SEQ ID NO: 11005 - DNA, 20 bp, Artificial Sequence
  Description of Artificial Sequence: Synthetic oligonucleotide
ctgaatgggtagcctatagc

SEQ ID NO: 11006 - DNA, 20 bp, Artificial Sequence
  Description of Artificial Sequence: Synthetic oligonucleotide
tgaatgggtagcctatagct

SEQ ID NO: 11007 - DNA, 20 bp, Artificial Sequence
  Description of Artificial Sequence: Synthetic oligonucleotide
gaatgggtagcctatagctt

SEQ ID NO: 11008 - DNA, 20 bp, Artificial Sequence
  Description of Artificial Sequence: Synthetic oligonucleotide
aatgggtagcctatagcttt

SEQ ID NO: 11009 - DNA, 20 bp, Artificial Sequence
  Description of Artificial Sequence: Synthetic oligonucleotide
atgggtagcctatagctttc

SEQ ID NO: 11010 - DNA, 20 bp, Artificial Sequence
  Description of Artificial Sequence: Synthetic oligonucleotide
tgggtagcctatagctttcc

SEQ ID NO: 11011 - DNA, 20 bp, Artificial Sequence
  Description of Artificial Sequence: Synthetic oligonucleotide
gggtagcctatagctttcct

SEQ ID NO: 11012 - DNA, 20 bp, Artificial Sequence
  Description of Artificial Sequence: Synthetic oligonucleotide
ggtagcctatagctttcctt

SEQ ID NO: 11013 - DNA, 20 bp, Artificial Sequence
  Description of Artificial Sequence: Synthetic oligonucleotide
gtagcctatagctttccttc

SEQ ID NO: 11014 - DNA, 20 bp, Artificial Sequence
  Description of Artificial Sequence: Synthetic oligonucleotide
tagcctatagctttccttcc

SEQ ID NO: 11015 - DNA, 20 bp, Artificial Sequence
  Description of Artificial Sequence: Synthetic oligonucleotide
agcctatagctttccttcca

SEQ ID NO: 11016 - DNA, 20 bp, Artificial Sequence
  Description of Artificial Sequence: Synthetic oligonucleotide
gcctatagctttccttccaa

SEQ ID NO: 11017 - DNA, 20 bp, Artificial Sequence
  Description of Artificial Sequence: Synthetic oligonucleotide
cctatagctttccttccaag

SEQ ID NO: 11018 - DNA, 20 bp, Artificial Sequence
  Description of Artificial Sequence: Synthetic oligonucleotide
ctatagctttccttccaagc

SEQ ID NO: 11019 - DNA, 20 bp, Artificial Sequence
  Description of Artificial Sequence: Synthetic oligonucleotide
tatagctttccttccaagcc

SEQ ID NO: 11020 - DNA, 20 bp, Artificial Sequence
  Description of Artificial Sequence: Synthetic oligonucleotide
atagctttccttccaagccc

SEQ ID NO: 11021 - DNA, 20 bp, Artificial Sequence
  Description of Artificial Sequence: Synthetic oligonucleotide
tagctttccttccaagcccg

SEQ ID NO: 11022 - DNA, 20 bp, Artificial Sequence
  Description of Artificial Sequence: Synthetic oligonucleotide
agctttccttccaagcccga

SEQ ID NO: 11023 - DNA, 20 bp, Artificial Sequence
  Description of Artificial Sequence: Synthetic oligonucleotide
gctttccttccaagcccgaa

SEQ ID NO: 11024 - DNA, 20 bp, Artificial Sequence
  Description of Artificial Sequence: Synthetic oligonucleotide
ctttccttccaagcccgaat

SEQ ID NO: 11025 - DNA, 20 bp, Artificial Sequence
  Description of Artificial Sequence: Synthetic oligonucleotide
tttccttccaagcccgaatg

SEQ ID NO: 11026 - DNA, 20 bp, Artificial Sequence
  Description of Artificial Sequence: Synthetic oligonucleotide
ttccttccaagcccgaatgc

SEQ ID NO: 11027 - DNA, 20 bp, Artificial Sequence
  Description of Artificial Sequence: Synthetic oligonucleotide
tccttccaagcccgaatgct

SEQ ID NO: 11028 - DNA, 20 bp, Artificial Sequence
  Description of Artificial Sequence: Synthetic oligonucleotide
ccttccaagcccgaatgctc

SEQ ID NO: 11029 - DNA, 20 bp, Artificial Sequence
  Description of Artificial Sequence: Synthetic oligonucleotide
cttccaagcccgaatgctcc

SEQ ID NO: 11030 - DNA, 20 bp, Artificial Sequence
  Description of Artificial Sequence: Synthetic oligonucleotide
ttccaagcccgaatgctcca

SEQ ID NO: 11031 - DNA, 20 bp, Artificial Sequence
  Description of Artificial Sequence: Synthetic oligonucleotide
tccaagcccgaatgctccac

SEQ ID NO: 11032 - DNA, 20 bp, Artificial Sequence
  Description of Artificial Sequence: Synthetic oligonucleotide
ccaagcccgaatgctccaca

SEQ ID NO: 11033 - DNA, 20 bp, Artificial Sequence
  Description of Artificial Sequence: Synthetic oligonucleotide
caagcccgaatgctccacaa

SEQ ID NO: 11034 - DNA, 20 bp, Artificial Sequence
  Description of Artificial Sequence: Synthetic oligonucleotide
aagcccgaatgctccacaag

SEQ ID NO: 11035 - DNA, 20 bp, Artificial Sequence
  Description of Artificial Sequence: Synthetic oligonucleotide
agcccgaatgctccacaagt

SEQ ID NO: 11036 - DNA, 20 bp, Artificial Sequence
  Description of Artificial Sequence: Synthetic oligonucleotide
gcccgaatgctccacaagtc

SEQ ID NO: 11037 - DNA, 20 bp, Artificial Sequence
  Description of Artificial Sequence: Synthetic oligonucleotide
cccgaatgctccacaagtca

SEQ ID NO: 11038 - DNA, 20 bp, Artificial Sequence
  Description of Artificial Sequence: Synthetic oligonucleotide
ccgaatgctccacaagtcag

SEQ ID NO: 11039 - DNA, 20 bp, Artificial Sequence
  Description of Artificial Sequence: Synthetic oligonucleotide
cgaatgctccacaagtcagc

SEQ ID NO: 11040 - DNA, 20 bp, Artificial Sequence
  Description of Artificial Sequence: Synthetic oligonucleotide
gaatgctccacaagtcagca

SEQ ID NO: 11041 - DNA, 20 bp, Artificial Sequence
  Description of Artificial Sequence: Synthetic oligonucleotide
aatgctccacaagtcagcat

SEQ ID NO: 11042 - DNA, 20 bp, Artificial Sequence
  Description of Artificial Sequence: Synthetic oligonucleotide
atgctccacaagtcagcatc

SEQ ID NO: 11043 - DNA, 20 bp, Artificial Sequence
  Description of Artificial Sequence: Synthetic oligonucleotide
tgctccacaagtcagcatct

SEQ ID NO: 11044 - DNA, 20 bp, Artificial Sequence
  Description of Artificial Sequence: Synthetic oligonucleotide
gctccacaagtcagcatctt

SEQ ID NO: 11045 - DNA, 20 bp, Artificial Sequence
  Description of Artificial Sequence: Synthetic oligonucleotide
ctccacaagtcagcatctta

SEQ ID NO: 11046 - DNA, 20 bp, Artificial Sequence
  Description of Artificial Sequence: Synthetic oligonucleotide
tccacaagtcagcatcttaa

SEQ ID NO: 11047 - DNA, 20 bp, Artificial Sequence
  Description of Artificial Sequence: Synthetic oligonucleotide
ccacaagtcagcatcttaaa

SEQ ID NO: 11048 - DNA, 20 bp, Artificial Sequence
  Description of Artificial Sequence: Synthetic oligonucleotide
cacaagtcagcatcttaaat

SEQ ID NO: 11049 - DNA, 20 bp, Artificial Sequence
  Description of Artificial Sequence: Synthetic oligonucleotide
acaagtcagcatcttaaata

SEQ ID NO: 11050 - DNA, 20 bp, Artificial Sequence
  Description of Artificial Sequence: Synthetic oligonucleotide
caagtcagcatcttaaatat

SEQ ID NO: 11051 - DNA, 20 bp, Artificial Sequence
  Description of Artificial Sequence: Synthetic oligonucleotide
aagtcagcatcttaaatatt

SEQ ID NO: 11052 - DNA, 20 bp, Artificial Sequence
  Description of Artificial Sequence: Synthetic oligonucleotide
agtcagcatcttaaatattg

SEQ ID NO: 11053 - DNA, 20 bp, Artificial Sequence
  Description of Artificial Sequence: Synthetic oligonucleotide
gtcagcatcttaaatattgt

SEQ ID NO: 11054 - DNA, 20 bp, Artificial Sequence
  Description of Artificial Sequence: Synthetic oligonucleotide
tcagcatcttaaatattgtt

SEQ ID NO: 11055 - DNA, 20 bp, Artificial Sequence
  Description of Artificial Sequence: Synthetic oligonucleotide
cagcatcttaaatattgttt

SEQ ID NO: 11056 - DNA, 20 bp, Artificial Sequence
  Description of Artificial Sequence: Synthetic oligonucleotide
agcatcttaaatattgtttg

SEQ ID NO: 11057 - DNA, 20 bp, Artificial Sequence
  Description of Artificial Sequence: Synthetic oligonucleotide
gcatcttaaatattgtttgc

SEQ ID NO: 11058 - DNA, 20 bp, Artificial Sequence
  Description of Artificial Sequence: Synthetic oligonucleotide
catcttaaatattgtttgct

SEQ ID NO: 11059 - DNA, 20 bp, Artificial Sequence
  Description of Artificial Sequence: Synthetic oligonucleotide
atcttaaatattgtttgctg

SEQ ID NO: 11060 - DNA, 20 bp, Artificial Sequence
  Description of Artificial Sequence: Synthetic oligonucleotide
tcttaaatattgtttgctgc

SEQ ID NO: 11061 - DNA, 20 bp, Artificial Sequence
  Description of Artificial Sequence: Synthetic oligonucleotide
cttaaatattgtttgctgcc

SEQ ID NO: 11062 - DNA, 20 bp, Artificial Sequence
  Description of Artificial Sequence: Synthetic oligonucleotide
ttaaatattgtttgctgcct

SEQ ID NO: 11063 - DNA, 20 bp, Artificial Sequence
  Description of Artificial Sequence: Synthetic oligonucleotide
taaatattgtttgctgcctg

SEQ ID NO: 11064 - DNA, 20 bp, Artificial Sequence
  Description of Artificial Sequence: Synthetic oligonucleotide
aaatattgtttgctgcctgt

SEQ ID NO: 11065 - DNA, 20 bp, Artificial Sequence
  Description of Artificial Sequence: Synthetic oligonucleotide
aatattgtttgctgcctgta

SEQ ID NO: 11066 - DNA, 20 bp, Artificial Sequence
  Description of Artificial Sequence: Synthetic oligonucleotide
atattgtttgctgcctgtac

SEQ ID NO: 11067 - DNA, 20 bp, Artificial Sequence
  Description of Artificial Sequence: Synthetic oligonucleotide
tattgtttgctgcctgtacc

SEQ ID NO: 11068 - DNA, 20 bp, Artificial Sequence
  Description of Artificial Sequence: Synthetic oligonucleotide
attgtttgctgcctgtacct

SEQ ID NO: 11069 - DNA, 20 bp, Artificial Sequence
  Description of Artificial Sequence: Synthetic oligonucleotide
ttgtttgctgcctgtacctc

SEQ ID NO: 11070 - DNA, 20 bp, Artificial Sequence
  Description of Artificial Sequence: Synthetic oligonucleotide
tgtttgctgcctgtacctcc

SEQ ID NO: 11071 - DNA, 20 bp, Artificial Sequence
  Description of Artificial Sequence: Synthetic oligonucleotide
gtttgctgcctgtacctcca

SEQ ID NO: 11072 - DNA, 20 bp, Artificial Sequence
  Description of Artificial Sequence: Synthetic oligonucleotide
tttgctgcctgtacctccac

SEQ ID NO: 11073 - DNA, 20 bp, Artificial Sequence
  Description of Artificial Sequence: Synthetic oligonucleotide
ttgctgcctgtacctccacc

SEQ ID NO: 11074 - DNA, 20 bp, Artificial Sequence
  Description of Artificial Sequence: Synthetic oligonucleotide
tgctgcctgtacctccaccc

SEQ ID NO: 11075 - DNA, 20 bp, Artificial Sequence
  Description of Artificial Sequence: Synthetic oligonucleotide
gctgcctgtacctccacccc

SEQ ID NO: 11076 - DNA, 20 bp, Artificial Sequence
  Description of Artificial Sequence: Synthetic oligonucleotide
ctgcctgtacctccacccct

SEQ ID NO: 11077 - DNA, 20 bp, Artificial Sequence
  Description of Artificial Sequence: Synthetic oligonucleotide
tgcctgtacctccaccccta

SEQ ID NO: 11078 - DNA, 20 bp, Artificial Sequence
  Description of Artificial Sequence: Synthetic oligonucleotide
gcctgtacctccacccctac

SEQ ID NO: 11079 - DNA, 20 bp, Artificial Sequence
  Description of Artificial Sequence: Synthetic oligonucleotide
cctgtacctccacccctacc

SEQ ID NO: 11080 - DNA, 20 bp, Artificial Sequence
  Description of Artificial Sequence: Synthetic oligonucleotide
ctgtacctccacccctacca

SEQ ID NO: 11081 - DNA, 20 bp, Artificial Sequence
  Description of Artificial Sequence: Synthetic oligonucleotide
tgtacctccacccctaccat

SEQ ID NO: 11082 - DNA, 20 bp, Artificial Sequence
  Description of Artificial Sequence: Synthetic oligonucleotide
gtacctccacccctaccatg

SEQ ID NO: 11083 - DNA, 20 bp, Artificial Sequence
  Description of Artificial Sequence: Synthetic oligonucleotide
tacctccacccctaccatgg

SEQ ID NO: 11084 - DNA, 20 bp, Artificial Sequence
  Description of Artificial Sequence: Synthetic oligonucleotide
acctccacccctaccatggc

SEQ ID NO: 11085 - DNA, 2224 bp, Homo sapiens
gggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcagatgccatctacgactgctcttccctctaccagaagaactaccgcatctctggagtgtataagcttcctcctgatgacttcctgggcagccctgaactggaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 11086 - DNA, 6693 bp, Homo sapiens
cagccatggtaggggtggaggtacaggcagcaaacaatatttaagatgctgacttgtggagcattcgggcttggaaggaaagctataggctacccattcagctcccctgtcagagactcaagctttgagaaaggctagcaaagagcaaggaaagagagaaaacaacaaagtggcgaggccctcagagtgaaagcgtaaggttcagtcagcctgctgcagctttgcagacctcagctgggcatctccagactcccctgaaggaagagccttcctcacccaaacccacaaaagatgctgaaaaagcctctctcagctgtgacctggctctgcattttcatcgtggcctttgtcagccacccagcgtggctgcagaagctctctaagcacaagacaccagcacagccacagctcaaagcggccaactgctgtgaggaggtgaaggagctcaaggcccaagttgccaaccttagcagcctgctgagtgaactgaacaagaagcaggagagggactgggtcagcgtggtcatgcaggtgatggagctggagagcaacagcaagcgcatggagtcgcggctcacagatgctgagagcaagtactccgagatgaacaaccaaattgacatcatgcagctgcaggcagcacagacggtcactcagacctccgcaggtaaggagaccagtcccctgagggagcgtggagtgcctccccatctacagcactgcttctacatatcctggtcatcagaaccactactggggcctcttttgtgggtacactttccctttagtaaaggcttatgcagtatttcctttgacttctaatgctatgtaagtttacctaacaccttcacgggtctcttttatccacacagtgtttcagcctaccatcttggagtgctgagatactacatggtttgcccaaagtcacccagcaagtcttagaagcagggttcaagtcttcctgattggtgtagctctgctacttcctcaccaagagctgacaggctatatctcaagaaattccaaggaagcaccaaactgtaacagctgttcctctggaagcaaagttttgccagaaacagttctctggtgttcctaagatttaccaggaatgagcattaatggaattttgtgtcctctctctgtaaacgtaactcttctcattggctcagagttaagtgtagagacacataaccatgtgaagagtccctttgtgttcaggaaggatgcggctccttaaggttcctcaattgtgatacgtctatttttttccatggtcttaaatgaatttctccgaatacaggattttttaaatgcaatgctgaaatatagacttaataggccaaaaataagataaatttaatctttcttttgcaaaataacttttatttctggttagctcagctcaggtgggccaacatgaatttacggtttagagataaaaatttggttttctgaaattatcaggaaaatattagttgtaaggagcatatcctatagacatgtcatttcttgctgatataaaaaccattggtcccattataaactacatgaagaacaaagacatgatcagcttctactgactaagtcaatggttaacctcagctcaaattaagaaaaagttttaacatgaaaccaagcttgaaaattctgttacctgaaccaacatgtatcaatcactttctaagcatggacttccgggccctcagtttgggattagaaaggtattctcaggccattttccagacaagtgagtcctgatttggtctgtgagatgaaaccagacatgcggaagaccaggccagacagaggaatctgaccgtgccacttcctgctcatccaaacaggaggctttctcaccatcctgcaaggaggttcttggggtcaagtgcagctctcccaccaggtctcttgctcttcttgcccaggacatcattccttatttttcttctctatgaccaagtgctcagttacccttatattctataagtaggtagtcccttagaggaagcagtaagttggtgctttcaccactaagacgaaatgaagaatagtgatggcgaaggcacacgtactctacctccctttcccaaggtgctctgcaagagaacctatgtgcctcagacaactcccatctgccatcttggtgctcctctctaaggtcccagtgcagtggtcaccaagaaaagcaccccgagacatagcaggcaggaagcttctcttggatagtaagggccgcagtctctgaatcctatcagaaaaggctgtctcttccactatgctctttgatatttagaatacagagcttaaatcctgcataaagtagcagctccatggccctagagtaaaaaaactggccagtctgatgctctcatttcattgttttaacaaaacttctgggaggaaggcctcaaaggttcttctgagtgttttgaggtgctagctggatggaaggggaaaatatgtgataataaaatctatctcccttaattatggtctcaggtggcagtagccaccatctctgaacaacaacaaaaacaaccaaccaggaaacatcaacaaaaccagactctatgagatattcacgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggattgcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatgtcctagaacagctattccttgggggaggagaaaagaaaacacgaaggcagcatcaaattatctggattttcacccaggcatggtggctcacacctgtaatcccaagttttttgggaggtgaggtgggcggaacaatcacctgaggtcaggactttgagaccagcctggccaacatgctgaaacccagtctctactaaaaatacaaaaattagcccagtgtggtgacaggcactctggtcccagctactaggaaggcaggagaatcactggaactcaggaggtggaggttgcagtgagccgagattgcaccactgtactctagcctgggcaacaagagtgaaattctgcttcaaaaaaaaaaaaagtatctggatttttccctccaagcttcatgtgcactcacccccgggcccaatttgcatcgttcttccagagcaatgcaccacccaccccagctcaccagcagtggggcagcatcactgcccgagtgagccagtgtgactgcgggagtgcacacatctactggctctgcagggacaggaacaggttgggaagcctgccctcttgctcctgccttctgcccctgcaagtccctcaccagagtatcccctctgcttcaggtgttctgtgacatggagacttcaggcggaggctggaccatcatccagagacgaaaaagtggccttgtctccttctaccgggactggaagcagtacaagcagggctttggcagcatccgtggggacttctggctggggaacgaacacatccaccggctctccagacagccaacccggctgcgtgtagagatggaggtaagcacaaggccaggggccccatgactggaccagtgccaccacacatgaccgcgtacaactccgggggtgccattcctattctgattcaagacaaatctgtatattcattgtgatggttttcctgcaagttgtaatggagttgaggaaaaataggtatttttcctttctgcaacccccccaaccccccgacaaaagtggggctgcaggtgggacaggaagaggccagacccaggccagagtagagcaaattcaacagtcagctgtgccgaacactagtctctgctctggccgagcatgaggtcctttaggtgcaaatcttactgatactgtttggggacccttgctgaaggtctgaaagcactcactatatcctcatgtttctcttacagcagctctgtgtgggattcagcaaaaacatagctgcaccttataagcaggaaagtgaggaatatagaaagagagactaatcaaggccatatggtgaatcaggaaagaagttcgagccttgttttctgattcccaggttaacacagtaaactggaggtaaacaagtaataaagtcttattagattcacacctataaaaagatgtttggctatgggactgtcaggagagaaggggtatagagacagcatgaaatggagcctgctgcactttctttaaggctctgctcctcctgacaggactgggagggcaacctgcgctacgctgagtatagccactttgttttgggcaatgaactcaacagctatcgcctcttcctggggaactacactggcaatgtggggaacgacgccctccagtatcataacaacacagccttcagcaccaaggacaaggacaatgacaactgcttggacaagtgtgcacagctccgcaaaggtgagatttggggggaccggaaaggagaagttcaggtacaagctcataatcccacttgaggagaaagagtgaattataactgtacagttgatattccggttttggtattctttctgaccctggctctaactccttacctgatgtctggtctatcacagtcaacttactagcactgggtctgtttctcatgccaggtggctactggtacaactgctgcacagactccaacctcaatggagtgtactaccgcctgggtgagcacaataagcacctggatggcatcacctggtatggctggcatggatctacctactccctcaaacgggtggagatgaaaatccgcccagaagacttcaagccttaaaaggaggctgccgtggagcacggatacagaaactgagacacgtggagactggatgagggcagatgaggacaggaagagagtgttagaaagggtaggactgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagaaccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggatgccggcacaaaactgccttaaaatattcatagttaatacaggtatatctatttttatttactttgtaagaaacaagctcaaggagcttccttttaaattttgtctgtaggaaatggttgaaaactgaaggtagatggtgttatagttaataataaatgctgtaaataagcatctcactttgtaaaaataaaatattgtggttttgttttaaacattcaacgtttcttttccttctacaataaacactttcaaaatgtga

SEQ ID NO: 11087 - DNA, 20 bp, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' O-methyl modified nucleoside
  misc_feature (3)..(4): Phosphorothioate linkage
  modified_base (4)..(4): 2' O-methyl modified nucleoside
  misc_feature (4)..(5): Phosphorothioate linkage
  modified_base (5)..(5): 2' O-methyl modified nucleoside
  misc_feature (5)..(6): Phosphorothioate linkage
  modified_base (6)..(6): Any deoxynucleotide
  misc_feature (6)..(7): Phosphorothioate linkage
  modified_base (7)..(7): Any deoxynucleotide
  misc_feature (7)..(8): Phosphorothioate linkage
  modified_base (8)..(8): Any deoxynucleotide
  misc_feature (8)..(9): Phosphorothioate linkage
  modified_base (9)..(9): Any deoxynucleotide
  misc_feature (9)..(10): Phosphorothioate linkage
  modified_base (10)..(10): Any deoxynucleotide
  misc_feature (10)..(11): Phosphorothioate linkage
  modified_base (11)..(11): Any deoxynucleotide
  misc_feature (11)..(12): Phosphorothioate linkage
  modified_base (12)..(12): Any deoxynucleotide
  misc_feature (12)..(13): Phosphorothioate linkage
  modified_base (13)..(13): Any deoxynucleotide
  misc_feature (13)..(14): Phosphorothioate linkage
  modified_base (14)..(14): Any deoxynucleotide
  misc_feature (14)..(15): Phosphorothioate linkage
  modified_base (15)..(15): Any deoxynucleotide
  misc_feature (15)..(16): Phosphorothioate linkage
  modified_base (16)..(16): 2' O-methyl modified nucleoside
  misc_feature (16)..(17): Phosphorothioate linkage
  modified_base (17)..(17): 2' O-methyl modified nucleoside
  misc_feature (17)..(18): Phosphorothioate linkage
  modified_base (18)..(18): 2' O-methyl modified nucleoside
  misc_feature (18)..(19): Phosphorothioate linkage
  modified_base (19)..(19): 2' O-methyl modified nucleoside
  misc_feature (19)..(20): Phosphorothioate linkage
  modified_base (20)..(20): 2' O-methyl modified nucleoside
ttgtaccagtagccaccttt

SEQ ID NO: 11088 - DNA, 20 bp, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' O-methyl modified nucleoside
  misc_feature (3)..(4): Phosphorothioate linkage
  modified_base (4)..(4): 2' O-methyl modified nucleoside
  misc_feature (4)..(5): Phosphorothioate linkage
  modified_base (5)..(5): 2' O-methyl modified nucleoside
  misc_feature (5)..(6): Phosphorothioate linkage
  modified_base (6)..(6): Any deoxynucleotide
  misc_feature (6)..(7): Phosphorothioate linkage
  modified_base (7)..(7): Any deoxynucleotide
  misc_feature (7)..(8): Phosphorothioate linkage
  modified_base (8)..(8): Any deoxynucleotide
  misc_feature (8)..(9): Phosphorothioate linkage
  modified_base (9)..(9): Any deoxynucleotide
  misc_feature (9)..(10): Phosphorothioate linkage
  modified_base (10)..(10): Any deoxynucleotide
  misc_feature (10)..(11): Phosphorothioate linkage
  modified_base (11)..(11): Any deoxynucleotide
  misc_feature (11)..(12): Phosphorothioate linkage
  modified_base (12)..(12): Any deoxynucleotide
  misc_feature (12)..(13): Phosphorothioate linkage
  modified_base (13)..(13): Any deoxynucleotide
  misc_feature (13)..(14): Phosphorothioate linkage
  modified_base (14)..(14): Any deoxynucleotide
  misc_feature (14)..(15): Phosphorothioate linkage
  modified_base (15)..(15): Any deoxynucleotide
  misc_feature (15)..(16): Phosphorothioate linkage
  modified_base (16)..(16): 2' O-methyl modified nucleoside
  misc_feature (16)..(17): Phosphorothioate linkage
  modified_base (17)..(17): 2' O-methyl modified nucleoside
  misc_feature (17)..(18): Phosphorothioate linkage
  modified_base (18)..(18): 2' O-methyl modified nucleoside
  misc_feature (18)..(19): Phosphorothioate linkage
  modified_base (19)..(19): 2' O-methyl modified nucleoside
  misc_feature (19)..(20): Phosphorothioate linkage
  modified_base (20)..(20): 2' O-methyl modified nucleoside
tctaaccgagctgatggact

SEQ ID NO: 11089 - RNA, 21 nt, Artificial Sequence
  Description of Artificial Sequence: Synthetic oligonucleotide
guacaacugcugcacagacuu

SEQ ID NO: 11090 - RNA, 21 nt, Artificial Sequence
  Description of Artificial Sequence: Synthetic oligonucleotide
gucugugcagcaguuguacuu

SEQ ID NO: 11091 - RNA, 21 nt, Artificial Sequence
  Description of Artificial Sequence: Synthetic oligonucleotide
guuguacagcaugcggagauu

SEQ ID NO: 11092 - RNA, 21 nt, Artificial Sequence
  Description of Artificial Sequence: Synthetic oligonucleotide
ucuccgcaugcuguacaacuu

SEQ ID NO: 11093 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggaaggaaagcuauaggcauu

SEQ ID NO: 11094 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cccugucagagacucaagauu

SEQ ID NO: 11095 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gaaaacaacaaaguggcgauu

SEQ ID NO: 11096 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aaacaacaaaguggcgagauu

SEQ ID NO: 11097 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cccucagagugaaagcguauu

SEQ ID NO: 11098 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccucagagugaaagcguaauu

SEQ ID NO: 11099 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cucagagugaaagcguaaauu

SEQ ID NO: 11100 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cagagugaaagcguaaggauu

SEQ ID NO: 11101 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agagugaaagcguaagguauu

SEQ ID NO: 11102 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gagugaaagcguaagguuauu

SEQ ID NO: 11103 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agugaaagcguaagguucauu

SEQ ID NO: 11104 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcguaagguucagucagcauu

SEQ ID NO: 11105 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucacccaaacccacaaaaauu

SEQ ID NO: 11106 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggcucugcauuuucaucgauu

SEQ ID NO: 11107 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aucguggccuuugucagcauu

SEQ ID NO: 11108 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucguggccuuugucagccauu

SEQ ID NO: 11109 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcaagcgcauggagucgcauu

SEQ ID NO: 11110 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caagcgcauggagucgcgauu

SEQ ID NO: 11111 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aagcgcauggagucgcggauu

SEQ ID NO: 11112 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggagucgcggcucacagaauu

SEQ ID NO: 11113 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gagucgcggcucacagauauu

SEQ ID NO: 11114 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gucgcggcucacagaugcauu

SEQ ID NO: 11115 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gacggucacucagaccucauu

SEQ ID NO: 11116 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cucagaccuccgcagaugauu

SEQ ID NO: 11117 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucagaccuccgcagaugcauu

SEQ ID NO: 11118 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccuccgcagaugccaucuauu

SEQ ID NO: 11119 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuccgcagaugccaucuaauu

SEQ ID NO: 11120 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccgcagaugccaucuacgauu

SEQ ID NO: 11121 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agaugccaucuacgacugauu

SEQ ID NO: 11122 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gaugccaucuacgacugcauu

SEQ ID NO: 11123 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccaucuacgacugcucuuauu

SEQ ID NO: 11124 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caucuacgacugcucuucauu

SEQ ID NO: 11125 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
accagaagaacuaccgcaauu

SEQ ID NO: 11126 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccagaagaacuaccgcauauu

SEQ ID NO: 11127 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gaacuaccgcaucucuggauu

SEQ ID NO: 11128 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccgcaucucuggaguguaauu

SEQ ID NO: 11129 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caucucuggaguguauaaauu

SEQ ID NO: 11130 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aucucuggaguguauaagauu

SEQ ID NO: 11131 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
accaucauccagagacgaauu

SEQ ID NO: 11132 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccaucauccagagacgaaauu

SEQ ID NO: 11133 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caucauccagagacgaaaauu

SEQ ID NO: 11134 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aucauccagagacgaaaaauu

SEQ ID NO: 11135 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucauccagagacgaaaaaauu

SEQ ID NO: 11136 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cagcauccguggggacuuauu

SEQ ID NO: 11137 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aacacauccaccggcucuauu

SEQ ID NO: 11138 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cauccaccggcucuccagauu

SEQ ID NO: 11139 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccaacccggcugcguguaauu

SEQ ID NO: 11140 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caacccggcugcguguagauu

SEQ ID NO: 11141 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aacccggcugcguguagaauu

SEQ ID NO: 11142 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggcugcguguagagauggauu

SEQ ID NO: 11143 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcugcguguagagauggaauu

SEQ ID NO: 11144 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcguguagagauggaggauu

SEQ ID NO: 11145 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agggcaaccugcgcuacgauu

SEQ ID NO: 11146 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gggcaaccugcgcuacgcauu

SEQ ID NO: 11147 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggcaaccugcgcuacgcuauu

SEQ ID NO: 11148 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcaaccugcgcuacgcugauu

SEQ ID NO: 11149 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cgcuacgcugaguauagcauu

SEQ ID NO: 11150 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcuacgcugaguauagccauu

SEQ ID NO: 11151 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuacgcugaguauagccaauu

SEQ ID NO: 11152 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uacgcugaguauagccacauu

SEQ ID NO: 11153 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gaacucaacagcuaucgcauu

SEQ ID NO: 11154 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aacagcuaucgccucuucauu

SEQ ID NO: 11155 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuggggaacuacacuggcauu

SEQ ID NO: 11156 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gggaacuacacuggcaauauu

SEQ ID NO: 11157 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aacuacacuggcaaugugauu

SEQ ID NO: 11158 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuacacuggcaaugugggauu

SEQ ID NO: 11159 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuggcaauguggggaacgauu

SEQ ID NO: 11160 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggcaauguggggaacgaauu

SEQ ID NO: 11161 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggcaauguggggaacgacauu

SEQ ID NO: 11162 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcaauguggggaacgacgauu

SEQ ID NO: 11163 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caauguggggaacgacgcauu

SEQ ID NO: 11164 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gggaacgacgcccuccagauu

SEQ ID NO: 11165 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gaacgacgcccuccaguaauu

SEQ ID NO: 11166 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aacgacgcccuccaguauauu

SEQ ID NO: 11167 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acgacgcccuccaguaucauu

SEQ ID NO: 11168 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcccuccaguaucauaacauu

SEQ ID NO: 11169 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aguaucauaacaacacagauu

SEQ ID NO: 11170 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuccgcaaagguggcuacauu

SEQ ID NO: 11171 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccgcaaagguggcuacuauu

SEQ ID NO: 11172 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caaagguggcuacugguaauu

SEQ ID NO: 11173 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aagguggcuacugguacaauu

SEQ ID NO: 11174 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
guggcuacugguacaacuauu

SEQ ID NO: 11175 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugguacaacugcugcacaauu

SEQ ID NO: 11176 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
guacaacugcugcacagaauu

SEQ ID NO: 11177 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccucaauggaguguacuaauu

SEQ ID NO: 11178 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cucaauggaguguacuacauu

SEQ ID NO: 11179 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucaauggaguguacuaccauu

SEQ ID NO: 11180 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
caauggaguguacuaccgauu

SEQ ID NO: 11181 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggcauggaucuaccuacauu

SEQ ID NO: 11182 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggcauggaucuaccuacuauu

SEQ ID NO: 11183 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cauggaucuaccuacuccauu

SEQ ID NO: 11184 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
auggaucuaccuacucccauu

SEQ ID NO: 11185 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cuuaaaaggaggcugccgauu

SEQ ID NO: 11186 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
auauguaccaaggauguuauu

SEQ ID NO: 11187 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguaccaaggauguuacaauu

SEQ ID NO: 11188 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aggauguuacaguaaacaauu

SEQ ID NO: 11189 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggauguuacaguaaacagauu

SEQ ID NO: 11190 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuaaacccacuggguccuauu

SEQ ID NO: 11191 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cccaagaucccugacauaauu

SEQ ID NO: 11192 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccaagaucccugacauagauu

SEQ ID NO: 11193 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aagaucccugacauagcaauu

SEQ ID NO: 11194 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agaucccugacauagcagauu

SEQ ID NO: 11195 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aucccugacauagcaguaauu

SEQ ID NO: 11196 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cccugacauagcaguagcauu

SEQ ID NO: 11197 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ccugacauagcaguagcuauu

SEQ ID NO: 11198 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acauagcaguagcuugucauu

SEQ ID NO: 11199 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cauagcaguagcuugucuauu

SEQ ID NO: 11200 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agcaguagcuugucuuuuauu

SEQ ID NO: 11201 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aaacacaaaucccuuugcauu

SEQ ID NO: 11202 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaggccuuugaguguuagauu

SEQ ID NO: 11203 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aggccuuugaguguuagaauu

SEQ ID NO: 11204 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aaauuaucuugagucuacauu

SEQ ID NO: 11205 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aauuaucuugagucuacaauu

SEQ ID NO: 11206 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aaacacaaaaauuguucgauu

SEQ ID NO: 11207 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acacaaaaauuguucggcauu

SEQ ID NO: 11208 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cacaaaaauuguucggcuauu

SEQ ID NO: 11209 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acaaaaauuguucggcugauu

SEQ ID NO: 11210 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cggcacaaaacugccuuaauu

SEQ ID NO: 11211 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gaagguagaugguguuauauu

SEQ ID NO: 11212 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
guagaugguguuauaguuauu

SEQ ID NO: 11213 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugccuauagcuuuccuuccuu

SEQ ID NO: 11214 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuugagucucugacaggguu

SEQ ID NO: 11215 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucgccacuuuguuguuuucuu

SEQ ID NO: 11216 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucucgccacuuuguuguuuuu

SEQ ID NO: 11217 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uacgcuuucacucugaggguu

SEQ ID NO: 11218 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuacgcuuucacucugagguu

SEQ ID NO: 11219 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuacgcuuucacucugaguu

SEQ ID NO: 11220 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccuuacgcuuucacucuguu

SEQ ID NO: 11221 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaccuuacgcuuucacucuuu

SEQ ID NO: 11222 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaaccuuacgcuuucacucuu

SEQ ID NO: 11223 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugaaccuuacgcuuucacuuu

SEQ ID NO: 11224 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcugacugaaccuuacgcuu

SEQ ID NO: 11225 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuuuguggguuugggugauu

SEQ ID NO: 11226 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucgaugaaaaugcagagccuu

SEQ ID NO: 11227 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcugacaaaggccacgauuu

SEQ ID NO: 11228 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggcugacaaaggccacgauu

SEQ ID NO: 11229 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcgacuccaugcgcuugcuu

SEQ ID NO: 11230 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucgcgacuccaugcgcuuguu

SEQ ID NO: 11231 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccgcgacuccaugcgcuuuu

SEQ ID NO: 11232 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucugugagccgcgacuccuu

SEQ ID NO: 11233 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaucugugagccgcgacucuu

SEQ ID NO: 11234 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcaucugugagccgcgacuu

SEQ ID NO: 11235 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugaggucugagugaccgucuu

SEQ ID NO: 11236 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucaucugcggaggucugaguu

SEQ ID NO: 11237 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcaucugcggaggucugauu

SEQ ID NO: 11238 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagauggcaucugcggagguu

SEQ ID NO: 11239 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuagauggcaucugcggaguu

SEQ ID NO: 11240 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucguagauggcaucugcgguu

SEQ ID NO: 11241 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucagucguagauggcaucuuu

SEQ ID NO: 11242 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcagucguagauggcaucuu

SEQ ID NO: 11243 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaagagcagucguagaugguu

SEQ ID NO: 11244 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugaagagcagucguagauguu

SEQ ID NO: 11245 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uugcgguaguucuucugguuu

SEQ ID NO: 11246 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaugcgguaguucuucugguu

SEQ ID NO: 11247 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccagagaugcgguaguucuu

SEQ ID NO: 11248 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuacacuccagagaugcgguu

SEQ ID NO: 11249 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuauacacuccagagauguu

SEQ ID NO: 11250 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuuauacacuccagagauuu

SEQ ID NO: 11251 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucgucucuggaugaugguuu

SEQ ID NO: 11252 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuucgucucuggaugaugguu

SEQ ID NO: 11253 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuucgucucuggaugauguu

SEQ ID NO: 11254 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuuucgucucuggaugauuu

SEQ ID NO: 11255 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuuuucgucucuggaugauu

SEQ ID NO: 11256 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaaguccccacggaugcuguu

SEQ ID NO: 11257 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagagccgguggauguguuuu

SEQ ID NO: 11258 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuggagagccgguggauguu

SEQ ID NO: 11259 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuacacgcagccggguugguu

SEQ ID NO: 11260 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuacacgcagccggguuguu

SEQ ID NO: 11261 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucuacacgcagccggguuuu

SEQ ID NO: 11262 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccaucucuacacgcagccuu

SEQ ID NO: 11263 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuccaucucuacacgcagcuu

SEQ ID NO: 11264 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccuccaucucuacacgcauu

SEQ ID NO: 11265 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucguagcgcagguugcccuuu

SEQ ID NO: 11266 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcguagcgcagguugcccuu

SEQ ID NO: 11267 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagcguagcgcagguugccuu

SEQ ID NO: 11268 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucagcguagcgcagguugcuu

SEQ ID NO: 11269 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcuauacucagcguagcguu

SEQ ID NO: 11270 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggcuauacucagcguagcuu

SEQ ID NO: 11271 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuggcuauacucagcguaguu

SEQ ID NO: 11272 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguggcuauacucagcguauu

SEQ ID NO: 11273 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcgauagcuguugaguucuu

SEQ ID NO: 11274 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugaagaggcgauagcuguuuu

SEQ ID NO: 11275 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugccaguguaguuccccaguu

SEQ ID NO: 11276 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uauugccaguguaguucccuu

SEQ ID NO: 11277 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucacauugccaguguaguuuu

SEQ ID NO: 11278 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucccacauugccaguguaguu

SEQ ID NO: 11279 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucguuccccacauugccaguu

SEQ ID NO: 11280 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucguuccccacauugccauu

SEQ ID NO: 11281 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugucguuccccacauugccuu

SEQ ID NO: 11282 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucgucguuccccacauugcuu

SEQ ID NO: 11283 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcgucguuccccacauuguu

SEQ ID NO: 11284 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuggagggcgucguucccuu

SEQ ID NO: 11285 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuacuggagggcgucguucuu

SEQ ID NO: 11286 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uauacuggagggcgucguuuu

SEQ ID NO: 11287 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugauacuggagggcgucguuu

SEQ ID NO: 11288 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguuaugauacuggagggcuu

SEQ ID NO: 11289 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuguguuguuaugauacuuu

SEQ ID NO: 11290 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguagccaccuuugcggaguu

SEQ ID NO: 11291 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaguagccaccuuugcggauu

SEQ ID NO: 11292 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuaccaguagccaccuuuguu

SEQ ID NO: 11293 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuguaccaguagccaccuuuu

SEQ ID NO: 11294 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaguuguaccaguagccacuu

SEQ ID NO: 11295 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uugugcagcaguuguaccauu

SEQ ID NO: 11296 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucugugcagcaguuguacuu

SEQ ID NO: 11297 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuaguacacuccauugagguu

SEQ ID NO: 11298 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguaguacacuccauugaguu

SEQ ID NO: 11299 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugguaguacacuccauugauu

SEQ ID NO: 11300 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucgguaguacacuccauuguu

SEQ ID NO: 11301 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguagguagauccaugccauu

SEQ ID NO: 11302 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaguagguagauccaugccuu

SEQ ID NO: 11303 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggaguagguagauccauguu

SEQ ID NO: 11304 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugggaguagguagauccauuu

SEQ ID NO: 11305 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucggcagccuccuuuuaaguu

SEQ ID NO: 11306 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaacauccuugguacauauuu

SEQ ID NO: 11307 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuguaacauccuugguacauu

SEQ ID NO: 11308 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuguuuacuguaacauccuuu

SEQ ID NO: 11309 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuguuuacuguaacauccuu

SEQ ID NO: 11310 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaggacccaguggguuuaauu

SEQ ID NO: 11311 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuaugucagggaucuuggguu

SEQ ID NO: 11312 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuaugucagggaucuugguu

SEQ ID NO: 11313 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uugcuaugucagggaucuuuu

SEQ ID NO: 11314 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucugcuaugucagggaucuuu

SEQ ID NO: 11315 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuacugcuaugucagggauuu

SEQ ID NO: 11316 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcuacugcuaugucaggguu

SEQ ID NO: 11317 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagcuacugcuaugucagguu

SEQ ID NO: 11318 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugacaagcuacugcuauguuu

SEQ ID NO: 11319 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagacaagcuacugcuauguu

SEQ ID NO: 11320 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaaaagacaagcuacugcuuu

SEQ ID NO: 11321 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcaaagggauuuguguuuuu

SEQ ID NO: 11322 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuaacacucaaaggccuauu

SEQ ID NO: 11323 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucuaacacucaaaggccuuu

SEQ ID NO: 11324 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguagacucaagauaauuuuu

SEQ ID NO: 11325 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuguagacucaagauaauuuu

SEQ ID NO: 11326 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucgaacaauuuuuguguuuuu

SEQ ID NO: 11327 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugccgaacaauuuuuguguuu

SEQ ID NO: 11328 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagccgaacaauuuuuguguu

SEQ ID NO: 11329 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucagccgaacaauuuuuguuu

SEQ ID NO: 11330 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuaaggcaguuuugugccguu

SEQ ID NO: 11331 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uauaacaccaucuaccuucuu

SEQ ID NO: 11332 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaacuauaacaccaucuacuu

SEQ ID NO: 11333 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggaccaucauccagagaauu

SEQ ID NO: 11334 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggaccaucauccagagacauu

SEQ ID NO: 11335 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cgccucuuccuggggaacauu

SEQ ID NO: 11336 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gacaacugcuuggacaagauu

SEQ ID NO: 11337 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acaacugcuuggacaaguauu

SEQ ID NO: 11338 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
aagguggcuacugguacaauu

SEQ ID NO: 11339 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
agguggcuacugguacaaauu

SEQ ID NO: 11340 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
guggcuacugguacaacuauu

SEQ ID NO: 11341 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uggcuacugguacaacugauu

SEQ ID NO: 11342 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ggcuacugguacaacugcauu

SEQ ID NO: 11343 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gcuacugguacaacugcuauu

SEQ ID NO: 11344 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acugguacaacugcugcaauu

SEQ ID NO: 11345 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugguacaacugcugcacaauu

SEQ ID NO: 11346 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
gguacaacugcugcacagauu

SEQ ID NO: 11347 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
guacaacugcugcacagaauu

SEQ ID NO: 11348 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uacaacugcugcacagacauu

SEQ ID NO: 11349 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cugcugcacagacuccaaauu

SEQ ID NO: 11350 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcugcacagacuccaacauu

SEQ ID NO: 11351 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cugcacagacuccaaccuauu

SEQ ID NO: 11352 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcacagacuccaaccucauu

SEQ ID NO: 11353 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
acagacuccaaccucaauauu

SEQ ID NO: 11354 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
cugguauggcuggcauggauu

SEQ ID NO: 11355 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucucuggaugaugguccauu

SEQ ID NO: 11356 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugucucuggaugaugguccuu

SEQ ID NO: 11357 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguuccccaggaagaggcguu

SEQ ID NO: 11358 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucuuguccaagcaguugucuu

SEQ ID NO: 11359 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uacuuguccaagcaguuguuu

SEQ ID NO: 11360 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuguaccaguagccaccuuuu

SEQ ID NO: 11361 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuguaccaguagccaccuuu

SEQ ID NO: 11362 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uaguuguaccaguagccacuu

SEQ ID NO: 11363 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucaguuguaccaguagccauu

SEQ ID NO: 11364 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugcaguuguaccaguagccuu

SEQ ID NO: 11365 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagcaguuguaccaguagcuu

SEQ ID NO: 11366 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uugcagcaguuguaccaguuu

SEQ ID NO: 11367 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uugugcagcaguuguaccauu

SEQ ID NO: 11368 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ucugugcagcaguuguaccuu

SEQ ID NO: 11369 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uucugugcagcaguuguacuu

SEQ ID NO: 11370 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugucugugcagcaguuguauu

SEQ ID NO: 11371 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uuuggagucugugcagcaguu

SEQ ID NO: 11372 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguuggagucugugcagcauu

SEQ ID NO: 11373 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uagguuggagucugugcaguu

SEQ ID NO: 11374 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
ugagguuggagucugugcauu

SEQ ID NO: 11375 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uauugagguuggagucuguuu

SEQ ID NO: 11376 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uccaugccagccauaccaguu

SEQ ID NO: 11377 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
auauguaccaaggauguuauu

SEQ ID NO: 11378 - RNA, 21 nt, Artificial Sequence
  Description of Artificial Sequence: Synthetic oligonucleotide
  modified_base (1)..(1): 2' fluoro-modified nucleoside
  misc_feature (1)..(2): Phosphorothioate linkage
  modified_base (2)..(2): 2' O-methyl modified nucleoside
  misc_feature (2)..(3): Phosphorothioate linkage
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' fluoro-modified nucleoside
  modified_base (9)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uguggcccgcacggggcaauu

SEQ ID NO: 11379 - RNA, 21 nt, Artificial Sequence
  Description of Artificial Sequence: Synthetic oligonucleotide
  modified_base (1)..(1): 2' O-methyl modified nucleoside
  misc_feature (1)..(2): Phosphorothioate linkage
  modified_base (2)..(2): 2' fluoro-modified nucleoside
  misc_feature (2)..(3): Phosphorothioate linkage
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(11): 2' O-methyl modified nucleoside
  modified_base (12)..(12): 2' O-methyl modified nucleoside
  modified_base (13)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(19): 2' O-methyl modified nucleoside
  misc_feature (19)..(20): Phosphorothioate linkage
  modified_base (20)..(20): 2' O-methyl modified nucleoside
  misc_feature (20)..(21): Phosphorothioate linkage
  modified_base (21)..(21): 2' O-methyl modified nucleoside
uugccccgugcgggccacauu

SEQ ID NO: 11380 - DNA, 20 bp, Artificial Sequence
  Description of Artificial Sequence: Synthetic oligonucleotide
  modified_base (1)..(1): Any 2' O-methyl or 2'O-methoxyethyl-modified nucleoside
  misc_feature (1)..(2): Phosphorothioate linkage
  modified_base (2)..(2): Any 2' O-methyl or 2'O-methoxyethyl-modified nucleoside
  misc_feature (2)..(3): Phosphorothioate linkage
  modified_base (3)..(3): Any 2' O-methyl or 2'O-methoxyethyl-modified nucleoside
  misc_feature (3)..(4): Phosphorothioate linkage
  modified_base (4)..(4): Any 2' O-methyl or 2'O-methoxyethyl-modified nucleoside
  misc_feature (4)..(5): Phosphorothioate linkage
  modified_base (5)..(5): Any 2' O-methyl or 2'O-methoxyethyl-modified nucleoside
  misc_feature (5)..(6): Phosphorothioate linkage
  modified_base (6)..(6): Any deoxynucleotide
  misc_feature (6)..(7): Phosphorothioate linkage
  modified_base (7)..(7): Any deoxynucleotide
  misc_feature (7)..(8): Phosphorothioate linkage
  modified_base (8)..(8): Any deoxynucleotide
  misc_feature (8)..(9): Phosphorothioate linkage
  modified_base (9)..(9): Any deoxynucleotide
  misc_feature (9)..(10): Phosphorothioate linkage
  modified_base (10)..(10): Any deoxynucleotide
  misc_feature (10)..(11): Phosphorothioate linkage
  modified_base (11)..(11): Any deoxynucleotide
  misc_feature (11)..(12): Phosphorothioate linkage
  modified_base (12)..(12): Any deoxynucleotide
  misc_feature (12)..(13): Phosphorothioate linkage
  modified_base (13)..(13): Any deoxynucleotide
  misc_feature (13)..(14): Phosphorothioate linkage
  modified_base (14)..(14): Any deoxynucleotide
  misc_feature (14)..(15): Phosphorothioate linkage
  modified_base (15)..(15): Any deoxynucleotide
  misc_feature (15)..(16): Phosphorothioate linkage
  modified_base (16)..(16): Any 2' O-methyl or 2'O-methoxyethyl-modified nucleoside
  misc_feature (16)..(17): Phosphorothioate linkage
  modified_base (17)..(17): Any 2' O-methyl or 2'O-methoxyethyl-modified nucleoside
  misc_feature (17)..(18): Phosphorothioate linkage
  modified_base (18)..(18): Any 2' O-methyl or 2'O-methoxyethyl-modified nucleoside
  misc_feature (18)..(19): Phosphorothioate linkage
  modified_base (19)..(19): Any 2' O-methyl or 2'O-methoxyethyl-modified nucleoside
  misc_feature (19)..(20): Phosphorothioate linkage
  modified_base (20)..(20): Any 2' O-methyl or 2'O-methoxyethyl-modified nucleoside
nnnnnnnnnnnnnnnnnnnn

SEQ ID NO: 11381 - RNA, 21 nt, Artificial Sequence
  Description of Artificial Sequence: Synthetic oligonucleotide
  modified_base (1)..(1): Any 2' fluoro-modified nucleoside
  misc_feature (1)..(2): Phosphorothioate linkage
  modified_base (2)..(2): Any 2' O-methyl modified nucleoside
  misc_feature (2)..(3): Phosphorothioate linkage
  modified_base (3)..(3): Any 2' fluoro-modified nucleoside
  modified_base (4)..(4): Any 2' O-methyl modified nucleoside
  modified_base (5)..(5): Any 2' fluoro-modified nucleoside
  modified_base (6)..(6): Any 2' O-methyl modified nucleoside
  modified_base (7)..(7): Any 2' fluoro-modified nucleoside
  modified_base (8)..(8): Any 2' fluoro-modified nucleoside
  modified_base (9)..(9): Any 2' fluoro-modified nucleoside
  modified_base (10)..(10): Any 2' O-methyl modified nucleoside
  modified_base (11)..(11): Any 2' fluoro-modified nucleoside
  modified_base (12)..(12): Any 2' O-methyl modified nucleoside
  modified_base (13)..(13): Any 2' fluoro-modified nucleoside
  modified_base (14)..(14): Any 2' O-methyl modified nucleoside
  modified_base (15)..(15): Any 2' fluoro-modified nucleoside
  modified_base (16)..(16): Any 2' O-methyl modified nucleoside
  modified_base (17)..(17): Any 2' fluoro-modified nucleoside
  modified_base (18)..(18): Any 2' O-methyl modified nucleoside
  modified_base (19)..(19): Any 2' fluoro-modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11382 - RNA, 21 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' O-methyl modified nucleoside
  misc_feature (2)..(3): Phosphorothioate linkage
  modified_base (3)..(3): Any 2' O-methyl modified nucleoside
  modified_base (4)..(4): Any 2' O-methyl modified nucleoside
  modified_base (5)..(5): Any 2' fluoro-modified nucleoside
  modified_base (6)..(6): Any 2' O-methyl modified nucleoside
  modified_base (7)..(7): Any 2' fluoro-modified nucleoside
  modified_base (8)..(8): Any 2' fluoro-modified nucleoside
  modified_base (9)..(9): Any 2' fluoro-modified nucleoside
  modified_base (10)..(10): Any 2' O-methyl modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' O-methyl modified nucleoside
  modified_base (15)..(15): Any 2' O-methyl modified nucleoside
  modified_base (16)..(16): Any 2' O-methyl modified nucleoside
  modified_base (17)..(17): Any 2' O-methyl modified nucleoside
  modified_base (18)..(18): Any 2' O-methyl modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11383 - RNA, 21 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' O-methyl modified nucleoside
  misc_feature (2)..(3): Phosphorothioate linkage
  modified_base (3)..(3): Any 2' O-methyl modified nucleoside
  modified_base (4)..(4): Any 2' O-methyl modified nucleoside
  modified_base (5)..(5): Any 2' fluoro-modified nucleoside
  modified_base (6)..(6): Any 2' O-methyl modified nucleoside
  modified_base (7)..(7): Any 2' fluoro-modified nucleoside
  modified_base (8)..(8): Any 2' O-methyl modified nucleoside
  modified_base (9)..(9): Any 2' fluoro-modified nucleoside
  modified_base (10)..(10): Any 2' O-methyl modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' O-methyl modified nucleoside
  modified_base (15)..(15): Any 2' O-methyl modified nucleoside
  modified_base (16)..(16): Any 2' O-methyl modified nucleoside
  modified_base (17)..(17): Any 2' O-methyl modified nucleoside
  modified_base (18)..(18): Any 2' O-methyl modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11384 - RNA, 22 nt, Artificial Sequence
  Description of Artificial Sequence: Synthetic oligonucleotide
  modified_base (1)..(1): Any 2' fluoro-modified nucleoside
  misc_feature (1)..(2): Phosphorothioate linkage
  modified_base (2)..(2): Any 2' O-methyl modified nucleoside
  misc_feature (2)..(3): Phosphorothioate linkage
  modified_base (3)..(3): Any 2' fluoro-modified nucleoside
  modified_base (4)..(4): Any 2' O-methyl modified nucleoside
  modified_base (5)..(5): Any 2' fluoro-modified nucleoside
  modified_base (6)..(6): Any 2' O-methyl modified nucleoside
  modified_base (7)..(7): Any 2' fluoro-modified nucleoside
  modified_base (8)..(8): Any 2' fluoro-modified nucleoside
  modified_base (9)..(9): Any 2' fluoro-modified nucleoside
  modified_base (10)..(10): Any 2' O-methyl modified nucleoside
  modified_base (11)..(11): Any 2' fluoro-modified nucleoside
  modified_base (12)..(12): Any 2' O-methyl modified nucleoside
  modified_base (13)..(13): Any 2' fluoro-modified nucleoside
  modified_base (14)..(14): Any 2' O-methyl modified nucleoside
  modified_base (15)..(15): Any 2' fluoro-modified nucleoside
  modified_base (16)..(16): Any 2' O-methyl modified nucleoside
  modified_base (17)..(17): Any 2' fluoro-modified nucleoside
  modified_base (18)..(18): Any 2' O-methyl modified nucleoside
  modified_base (19)..(19): Any 2' fluoro-modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
  modified_base (22)..(22): Any nucleoside
  See specification as filed for detailed description of substitutions and preferred embodiments
nnnnnnnnnnnnnnnnnnnnnn

SEQ ID NO: 11385 - RNA, 22 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' O-methyl modified nucleoside
  misc_feature (2)..(3): Phosphorothioate linkage
  modified_base (3)..(3): Any 2' O-methyl modified nucleoside
  modified_base (4)..(4): Any 2' O-methyl modified nucleoside
  modified_base (5)..(5): Any 2' fluoro-modified nucleoside
  modified_base (6)..(6): Any 2' O-methyl modified nucleoside
  modified_base (7)..(7): Any 2' fluoro-modified nucleoside
  modified_base (8)..(8): Any 2' fluoro-modified nucleoside
  modified_base (9)..(9): Any 2' fluoro-modified nucleoside
  modified_base (10)..(10): Any 2' O-methyl modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' O-methyl modified nucleoside
  modified_base (15)..(15): Any 2' O-methyl modified nucleoside
  modified_base (16)..(16): Any 2' O-methyl modified nucleoside
  modified_base (17)..(17): Any 2' O-methyl modified nucleoside
  modified_base (18)..(18): Any 2' O-methyl modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
  modified_base (22)..(22): Any nucleoside
  See specification as filed for detailed description of substitutions and preferred embodiments
nnnnnnnnnnnnnnnnnnnnnn

SEQ ID NO: 11386 - RNA, 21 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' fluoro-modified nucleoside
  misc_feature (2)..(3): Phosphorothioate linkage
  modified_base (3)..(3): Any 2' O-methyl modified nucleoside
  modified_base (4)..(4): Any 2' fluoro-modified nucleoside
  modified_base (5)..(5): Any 2' O-methyl modified nucleoside
  modified_base (6)..(6): Any 2' fluoro-modified nucleoside
  modified_base (7)..(7): Any 2' O-methyl modified nucleoside
  modified_base (8)..(8): Any 2' fluoro-modified nucleoside
  modified_base (9)..(9): Any 2' O-methyl modified nucleoside
  modified_base (10)..(10): Any 2' fluoro-modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' fluoro-modified nucleoside
  modified_base (15)..(15): Any 2' O-methyl modified nucleoside
  modified_base (16)..(16): Any 2' fluoro-modified nucleoside
  modified_base (17)..(17): Any 2' O-methyl modified nucleoside
  modified_base (18)..(18): Any 2' fluoro-modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11387 - RNA, 21 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' fluoro-modified nucleoside
  misc_feature (2)..(3): Phosphorothioate linkage
  modified_base (3)..(3): Any 2' O-methyl modified nucleoside
  modified_base (4)..(4): Any 2' O-methyl modified nucleoside
  modified_base (5)..(5): Any 2' O-methyl modified nucleoside
  modified_base (6)..(6): Any 2' fluoro-modified nucleoside
  modified_base (7)..(7): Any 2' O-methyl modified nucleoside
  modified_base (8)..(8): Any 2' fluoro-modified nucleoside
  modified_base (9)..(9): Any 2' fluoro-modified nucleoside
  modified_base (10)..(10): Any 2' O-methyl modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' fluoro-modified nucleoside
  modified_base (15)..(15): Any 2' O-methyl modified nucleoside
  modified_base (16)..(16): Any 2' fluoro-modified nucleoside
  modified_base (17)..(17): Any 2' O-methyl modified nucleoside
  modified_base (18)..(18): Any 2' O-methyl modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11388 - RNA, 21 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' fluoro-modified nucleoside
  misc_feature (2)..(3): Phosphorothioate linkage
  modified_base (3)..(3): Any 2' O-methyl modified nucleoside
  modified_base (4)..(4): Any 2' O-methyl modified nucleoside
  modified_base (5)..(5): Any 2' O-methyl modified nucleoside
  modified_base (6)..(6): Any 2' fluoro-modified nucleoside
  modified_base (7)..(7): Any 2' O-methyl modified nucleoside
  modified_base (8)..(8): Any 2' O-methyl modified nucleoside
  modified_base (9)..(9): Any 2' O-methyl modified nucleoside
  modified_base (10)..(10): Any 2' O-methyl modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' fluoro-modified nucleoside
  modified_base (15)..(15): Any 2' O-methyl modified nucleoside
  modified_base (16)..(16): Any 2' fluoro-modified nucleoside
  modified_base (17)..(17): Any 2' O-methyl modified nucleoside
  modified_base (18)..(18): Any 2' O-methyl modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11389 - RNA, 21 nt, Artificial Sequence
  Description of Artificial Sequence: Synthetic oligonucleotide
  modified_base (1)..(1): Any 2' O-methyl modified nucleoside
  misc_feature (1)..(2): Phosphorothioate linkage
  modified_base (2)..(2): Any 2' fluoro-modified nucleoside
  misc_feature (2)..(3): Phosphorothioate linkage
  modified_base (3)..(3): Any 2' O-methyl modified nucleoside
  modified_base (4)..(4): Any 2' fluoro-modified nucleoside
  modified_base (5)..(5): Any 2' O-methyl modified nucleoside
  modified_base (6)..(6): Any 2' fluoro-modified nucleoside
  modified_base (7)..(7): Any 2' O-methyl modified nucleoside
  modified_base (8)..(8): Any 2' O-methyl modified nucleoside
  modified_base (9)..(9): Any 2' O-methyl modified nucleoside
  modified_base (10)..(10): Any 2' O-methyl modified nucleoside
  modified_base (11)..(11): Any 2' O-methyl modified nucleoside
  modified_base (12)..(12): Any 2' O-methyl modified nucleoside
  modified_base (13)..(13): Any 2' O-methyl modified nucleoside
  modified_base (14)..(14): Any 2' fluoro-modified nucleoside
  modified_base (15)..(15): Any 2' O-methyl modified nucleoside
  modified_base (16)..(16): Any 2' fluoro-modified nucleoside
  modified_base (17)..(17): Any 2' O-methyl modified nucleoside
  modified_base (18)..(18): Any 2' O-methyl modified nucleoside
  modified_base (19)..(19): Any 2' O-methyl modified nucleoside
  misc_feature (19)..(20): Phosphorothioate linkage
  modified_base (20)..(20): Any 2' O-methyl modified nucleoside
  misc_feature (20)..(21): Phosphorothioate linkage
  modified_base (21)..(21): Any 2' O-methyl modified nucleoside
nnnnnnnnnnnnnnnnnnnnn

SEQ ID NO: 11390 - protein, 16 aa, Unknown
  Description of Unknown: RFGF sequence
AAVALLPAVLLALLAP

SEQ ID NO: 11391 - protein, 11 aa, Unknown
  Description of Unknown: RFGF analogue sequence
AALLPVLLAAP

SEQ ID NO: 11392 - protein, 13 aa, Human immunodeficiency virus 1
GRKKRRQRRRPPQ

SEQ ID NO: 11393 - protein, 15 aa, Drosophila sp.
RQIKIWFQNRRMKWK

We claim:

1. A composition comprising an oligonucleotide that targets Angiopoietin like 7 (ANGPTL7) and when administered to a cell decreases expression of ANGPTL7, wherein the oligonucleotide comprises a small interfering RNA (siRNA) comprising a sense strand and an antisense strand, wherein the sense strand comprises an oligonucleotide sequence of SEQ ID NOs: 1424, 1541, or 2091 in which at least one internucleoside linkage is modified and at least one nucleoside is modified, or an oligonucleotide sequence comprising 1 or 2 nucleoside substitutions, additions, or deletions of SEQ ID NOs: 1424, 1541, or 2091 in which at least one internucleoside linkage is modified and at least one nucleoside is modified, and wherein the antisense strand comprises an oligonucleotide sequence of SEQ ID NOs: 3630, 3747, or 4297 in which at least one internucleoside linkage is modified and at least one nucleoside is modified, or an oligonucleotide sequence comprising 1 or 2 nucleoside substitutions, additions, or deletions of SEQ ID NOs: 3630, 3747, or 4297 in which at least one internucleoside linkage is modified and at least one nucleoside is modified.

2. The composition of claim 1, wherein the at least one nucleoside is modified comprises a 2'-fluoro modified nucleoside.

3. The composition of claim 1, wherein the at least one nucleoside is modified comprises a 2'-O-methyl modified nucleoside.

4. The composition of claim 1, wherein the oligonucleotide comprises 15-23 modified nucleosides.

5. The composition of claim 4, wherein the 15-23 modified nucleosides comprises 2'-fluoro modified nucleosides and 2'-O-methyl modified nucleosides.

6. The composition of claim 1, wherein the at least one internucleoside linkage is modified comprises a phosphorothioate linkage.

7. The composition of claim 1, wherein the oligonucleotide comprises a lipid attached at a 3' or 5' terminus of the oligonucleotide.

8. The composition of claim 7, wherein the lipid comprises cholesterol, myristoyl, palmitoyl, stearoyl, lithocholoyl, docosanoyl, docosahexaenoyl, myristyl, palmityl stearyl, or a-tocopherol, or a combination thereof.

9. The composition of claim 8, wherein the lipid is attached to the 3' terminus of the sense strand.

10. The composition of claim 9, wherein the lipid comprises cholesterol.

11. The composition of claim 10, wherein the sense strand comprises an oligonucleotide sequence of SEQ ID NO: 11186 and the antisense strand comprises an oligonucleotide sequence of SEQ ID NO: 11306.

12. The composition of claim 10, wherein the sense strand comprises an oligonucleotide sequence of SEQ ID NO: 11200 and the antisense strand comprises an oligonucleotide sequence of SEQ ID NO: 11320.

13. The composition of claim 10, wherein the sense strand comprises an oligonucleotide sequence of SEQ ID NO: 11211 and the antisense strand comprises an oligonucleotide sequence of SEQ ID NO: 11331.

14. A pharmaceutical composition comprising
   (a) an oligonucleotide that targets Angiopoietin like 7 (ANGPTL7) and when administered to a cell decreases expression of ANGPTL7, wherein the oligonucleotide comprises a small interfering RNA (siRNA) comprising a sense strand and an antisense strand, wherein the sense strand comprises an oligonucleotide sequence of SEQ ID NOs: 1424, 1541, or 2091 in which at least one internucleoside linkage is modified and at least one nucleoside is modified, or an oligonucleotide sequence comprising 1 or 2 nucleoside substitutions, additions, or deletions of SEQ ID NOs: 1424, 1541, or 2091 in which at least one internucleoside linkage is modified and at least one nucleoside is modified, and wherein the antisense strand comprises an oligonucleotide sequence of SEQ ID NOs: 3630, 3747, or 4297 in which at least one internucleoside linkage is modified and at least one nucleoside is modified, or an oligonucleotide sequence comprising 1 or 2 nucleoside substitutions, additions, or deletions of SEQ ID NOs: 3630, 3747, or 4297 in which at least one internucleoside linkage is modified and at least one nucleoside is modified; and (b) a pharmaceutically acceptable carrier.

15. A composition comprising an oligonucleotide that targets Angiopoietin like 7 (ANGPTL7) and when administered to a subject in an effective amount decreases intraocular pressure, wherein the oligonucleotide comprises a small interfering RNA (siRNA) comprising a sense strand and an antisense strand, the antisense strand being complementary to a portion of a nucleic acid having the nucleoside sequence of SEQ ID NO: 11085, and each strand having 14 to 30 nucleotides, wherein the oligonucleotide comprises a lipid attached at a 3' or 5' terminus of the oligonucleotide, wherein the sense strand comprises an oligonucleotide sequence of SEQ ID NOs: 1424, 1541, or 2091 in which at least one internucleoside linkage is modified and at least one nucleoside is modified, or an oligonucleotide sequence comprising 1 or 2 nucleoside substitutions, additions, or deletions of SEQ ID NOs: 1424, 1541, or 2091 in which at least one internucleoside linkage is modified and at least one nucleoside is modified, and wherein the antisense strand comprises an oligonucleotide sequence of SEQ ID NOs: 3630, 3747, or 4297 in which at least one internucleoside linkage is modified and at least one nucleoside is modified, or an oligonucleotide sequence comprising 1 or 2 nucleoside substitutions, additions, or deletions of SEQ ID NOs: 3630, 3747, or 4297 in which at least one internucleoside linkage is modified and at least one nucleoside is modified.

16. The composition of claim 15, wherein the lipid is attached to the 3' terminus of the sense strand.

17. The composition of claim 16, wherein the lipid comprises cholesterol.

18. The composition of claim 17, wherein the sense strand comprises an oligonucleotide sequence of SEQ ID NO: 11186 and the antisense strand comprises an oligonucleotide sequence of SEQ ID NO: 11306.

19. The composition of claim 17, wherein the sense strand comprises an oligonucleotide sequence of SEQ ID NO: 11200 and the antisense strand comprises an oligonucleotide sequence of SEQ ID NO: 11320.

20. The composition of claim 17, wherein the sense strand comprises an oligonucleotide sequence of SEQ ID NO: 11211 and the antisense strand comprises an oligonucleotide sequence of SEQ ID NO: 11331.

* * * * *